(12) United States Patent
Quintanar-Audelo et al.

(10) Patent No.: US 9,617,573 B2
(45) Date of Patent: Apr. 11, 2017

(54) ENGINEERED TRANSAMINASE POLYPEPTIDES FOR INDUSTRIAL BIOCATALYSIS

(71) Applicant: Codexis, Inc., Redwood City, CA (US)

(72) Inventors: Martina Quintanar-Audelo, Edinburgh (GB); Ellen Eberhard, Fallbrook, CA (US); Jovana Nazor, Santa Clara, CA (US); Derek Smith, Singapore (SG); Cuixia Wang, Singapore (SG)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 14/768,408

(22) PCT Filed: Feb. 24, 2014

(86) PCT No.: PCT/US2014/018005
§ 371 (c)(1),
(2) Date: Aug. 17, 2015

(87) PCT Pub. No.: WO2014/133960
PCT Pub. Date: Sep. 4, 2014

(65) Prior Publication Data
US 2016/0002688 A1    Jan. 7, 2016

Related U.S. Application Data

(60) Provisional application No. 61/770,814, filed on Feb. 28, 2013.

(51) Int. Cl.
| | | |
|---|---|---|
| C12P 17/18 | (2006.01) | |
| C12N 9/10 | (2006.01) | |
| C12N 13/00 | (2006.01) | |
| C12P 13/00 | (2006.01) | |

(52) U.S. Cl.
CPC .......... *C12P 17/182* (2013.01); *C12N 9/1096* (2013.01); *C12P 13/001* (2013.01); *C12Y 206/01* (2013.01)

(58) Field of Classification Search
CPC ... C12N 9/1096; C12Y 206/01; C12P 17/182; C12P 13/001
USPC ........... 435/119, 128, 180, 193, 252.3, 320.1
See application file for complete search history.

(56) References Cited

U.S. PATENT DOCUMENTS

| | | | |
|---|---|---|---|
| 4,518,692 A | 5/1985 | Rozzell | |
| 4,600,692 A | 7/1986 | Wood et al. | |
| 4,826,766 A | 5/1989 | Rozzell | |
| 4,950,606 A | 8/1990 | Stirling et al. | |
| 5,169,780 A | 12/1992 | Stirling et al. | |
| 5,300,437 A | 4/1994 | Stirling et al. | |
| 5,316,943 A | 5/1994 | Kidman et al. | |
| 6,117,679 A | 9/2000 | Stemmer | |
| 6,197,558 B1 | 3/2001 | Fotheringham | |
| 6,376,246 B1 | 4/2002 | Crameri et al. | |
| 6,537,746 B2 | 3/2003 | Arnold et al. | |
| 6,586,182 B1 | 7/2003 | Patten et al. | |
| 7,169,592 B2 | 1/2007 | Yamada et al. | |
| 7,326,708 B2 | 2/2008 | Cypes et al. | |
| 7,618,799 B2 | 11/2009 | Coleman et al. | |
| 8,293,507 B2 | 10/2012 | Savile et al. | |
| 2002/0192786 A1 | 12/2002 | Yamada et al. | |
| 2006/0195947 A1 | 8/2006 | Davis et al. | |
| 2008/0213845 A1 | 9/2008 | Fotheringham et al. | |
| 2008/0220990 A1 | 9/2008 | Fox | |
| 2009/0312196 A1 | 12/2009 | Colbeck et al. | |
| 2010/0285541 A1 | 11/2010 | Saville et al. | |
| 2012/0329108 A1 | 12/2012 | Savile et al. | |

FOREIGN PATENT DOCUMENTS

| | | |
|---|---|---|
| WO | 95/22625 A1 | 8/1995 |
| WO | 95/33836 A1 | 12/1995 |
| WO | 96/00787 A1 | 1/1996 |
| WO | 97/00078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2005/005633 A2 | 1/2005 |
| WO | 2008/127646 A2 | 10/2008 |
| WO | 2009/008908 A2 | 1/2009 |
| WO | 2010/099501 A2 | 9/2010 |
| WO | 2011/005477 A1 | 1/2011 |
| WO | 2011/017551 A1 | 2/2011 |
| WO | 2011/159910 A2 | 12/2011 |
| WO | 2012/024100 A2 | 2/2012 |
| WO | 2012/024104 A2 | 2/2012 |
| WO | 2012/177527 A1 | 12/2012 |

(Continued)

OTHER PUBLICATIONS

Yonaha, K., et al., "Distribution of ω-Amino Acid : Pyruvate Transaminase and Aminobutyrate : α-Ketoglutarate Transaminase in Microorganisms," Agric. Biol. Chem., 47 (10):2257-2265 [1983].
Yun, H., et al., "ω-Amino Acid:Pyruvate Transaminase from Alcaligenes denitrificans Y2k-2: a New Catalyst for Kinetic Resolution of β-Amino Acids and Amines ," Appl. Environ. Microbiol., 70:2529-2534 [2004].
Zhang, H., et al., "PolyA_DB: a database for mammalian mRNA polyadenylation," Nucleic Acids Res. 33:D116-D120 (2005).
Zhang, J-H., et al., "Directed evolution of a fucosidase from a galactosidase by DNA shuffling and screening ," Proc. Nat. Acad. Sci., U.S.A., 94:4504-4509 (1997).
Zhao, H., et al., "Molecular evolution by staggered extension process (StEP) in vitro recombination," Nat. Biotechnol., 16:258-261 (1998).

(Continued)

*Primary Examiner* — Tekchand Saidha
*Assistant Examiner* — Md. Younus Meah
(74) *Attorney, Agent, or Firm* — Codexis, Inc.

(57) ABSTRACT

The present disclosure provides engineered transaminase polypeptides useful for the synthesis of chiral amine compounds under industrially relevant conditions. The disclosure also provides polynucleotides encoding the engineered transaminase polypeptides, host cells capable of expressing the engineered transaminases, and methods of using the engineered transaminases for the production of chiral amine compounds.

26 Claims, No Drawings

(56) References Cited

FOREIGN PATENT DOCUMENTS

WO    2013/036861 A1    3/2013
WO    2014/133960 A1    9/2014

OTHER PUBLICATIONS

GenBank Accession No. BAK39753.1 dated Feb. 16, 2012.
GenBank Accession No. ABA47738.1 dated Jan. 31, 2014.
GenBank Accession No. AEA39183.1 dated Apr. 4, 2011.
GenBank Accession No. AM902716.1 dated Feb. 27, 2015.
NCBI Accession No. YP_002257813 dated Aug. 27, 2013.
Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Beaucage, S.L., et al., "Deoxynucleoside phosphoamidites—A new class of key intermediates for deoxypolynucleotide synthesis," Tetrahedron Letters, 22(20):1859-62 (1981).
Black, M.E., et al., "Creation of drug-specific herpes simplex virus type 1 thymidine kinase mutants for gene therapy," Proc Natl Acad Sci USA, 93:3525-3529 (1996).
Botstein, D., et al., "Strategies and applications of in vitro mutagenesis," Science, 229(4719):1193-1201, 1985.
Caldwell, R.C., et al., "Mutagenic PCR," PCR Methods Appl., 3:S136-S140 (1994).
Carey, F., "Sulfonate esters as substrates in nucleophilic substitution reactions," Organic Chemistry, 2nd ed., pp. 328-331 [1992].
Carter, P., "Site-directed mutagenesis," Biochem. J., 237:1-7 (1986).
Christians, F.C., et al., "Directed evolution of thymidine kinase for AZT phosphorylation using DNA family shuffling," Nat. Biotechnol., 17:259-264 (1999).
Crameri, A., et al., "Molecular evolution of an arsenate detoxification pathway by DNA shuffling," Nat. Biotechnol., 15(5):436-438 (1997).
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling,"Nat. Biotechnol., 14(3):315-319 (1996).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Ehrlich, S.D., "DNA cloning in Bacillus subtilis," Proc Natl Acad Sci. USA, 75:1433 (1978).
Fasman, G.D.,CRC Practical Handbook of Biochemistry and Molecular Biology, CRC Press, Boca Raton, FL, pp. 3-70 [1989].
Guo, Z., et al., "3'-End-Forming Signals of Yeast mRNA," Mol. Cell. Biol., 15(11):5983-5990 [1995].
Henikoff, S.,et al., "Amino acid substitution matrices from protein blocks," Proc. Natl. Acad. Sci., 89:10915-10919 (1992).
Höhne, M., et al., "Efficient Asymmetric Synthesis of Chiral Amines by Combining Transaminase and Pyruvate Decarboxylase", ChemBioChem, 9:363-365 (2008).
Hwang, B.-Y., et al., "High-throughput screening method for the identification of active and enantioselective ω-transaminases", Enzyme and Microbial Technology, 34:429-436, 2004.
Iwasaki, A., et al., "Microbial synthesis of (R)- and (S)-3,4-dimethoxyamphetamines through stereoselective transamination," Biotech. Lett., 25:1843-1846 [2003].
Iwasaki, A., et al., "A novel transaminase, (R)-amine:pyruvate aminotransferase, from *Arthrobacter* sp. KNK168 (FERM BP-5228):purification, characterization, and gene cloning," Appl. Microbiol. Biotechnol., 93(4): 1563-1573 (2012).

Iwasaki, A., et al., "Microbial synthesis of chiral amines by (R)-specific transamination with *Arthrobacter* sp. KNK168," Appl. Microbiol. Biotechnol., 69: 499-505 (2006).
Koszelewski, D., et al., "Asymmetric Synthesis of Optically Pure Pharmacologically Relevant Amines Employing ω-Transaminases", Adv. Synth. Catal., 350:2761-2766 (2008).
Koszelewski, D., et al., "Immobilization of omega-transaminases by encapsulation in a sol-gel/celite matrix," Journal of Molecular Catalysis B: Enzymatic, 63: 39-44 (2010).
Kramer, B., et al., "Different base/base mismatches are corrected with different efficiencies by the methyl-directed DNA mismatch-repair system of *E. coli*," Cell, 38(3):879-887, 1984.
Lathe, R., et al., "Plasmid and bacteriophage vectors for excision of intact inserts," Gene, 57:193-201 (1987).
Lei, S.P, et al., "Characterization of the *Erwinia carotovora* pelB Gene and Its Product Pectate Lyase," J Bacteriol. 169(9):4379-4383 (1987).
Ling, M., et al., "Approaches to DNA Mutagenesis:An Overview," Anal. Biochem., 254:157-78 (1997).
Martin, A.R., et al., "Characterization of free and immobilized (S)-aminotransferase for acetophenone production," Applied Microbiology and Biotechnology, 76(4): 843-851 (2007).
Mateo, C., et al., "Epoxy sepabeads: a novel epoxy support for stabilization of industrial enzymes via very intense multipoint covalent attachment," Biotechnology Progress 18(3):629-34 (2002).
Matthes, H.W.D., et al., "Simultaneous rapid chemical synthesis of over one hundred oligonucleotides on a microscale," EMBO J., 3(4):801-05 (1984).
Minshull, J., et al., "Protein evolution by molecular breeding," Curr. Op. Chem. Biol., 3(3):284-290 (1999).
Needleman, S., et al., "A general method applicable to the search for similarities in the amino acid sequence of two proteins," J. Mol. Biol. 48:443-453 (1970).
Pearson, W.R., "Improved tools for biological sequence comparison," Proc. Nat'l. Acad. Sci. USA, 85:2444-2448 (1988).
Romanos, M.A., et al., "Foreign gene expression in yeast: a review," Yeast 8:423-488 [1992].
Savile, C.K., et al., "Biocatalytic asymmetric synthesis of chiral amines from ketones applied to sitagliptin manufacture," Science 329(5989):305-9 (2010).
Shin, J.S., et al., "Comparison of the omega-transaminases from different microorganisms and application to production of chiral amines," Biosci. Biotechnol. Biochem. 65:1782-1788 (2001).
Shin, J.S., et al., "Purification, characterization, and molecular cloning of a novel amine:pyruvate transaminase from Vibrio fluvialis JS17," Appl. Microbiol. Biotechnol., 61(5-6):463-471 [2003].
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Streitwieser, Jr., A., et al., Introduction to Organic Chemistry, 2nd ed., pp. 169-171 (1981).
Truppo, M.D., et al., "Development of an Improved Immobilized CAL-B for the Enzymatic Resolution of a Key Intermediate to Odanacatib," Organic Process Research & Development, 15:1033-1035 (2011).
Van Ophem, P.W., et al., "Substrate inhibition of D-amino acid transaminase and protection by salts and by reduced nicotinamide adenine dinucleotide: isolation and initial characterization of a pyridoxo intermediate related to inactivation.," Biochemistry 37(9):2879-88 (1998).
Villa-Komaroff, L., et al., "A bacterial clone synthesizing proinsulin," Proc. Natl. Acad. Sci. USA, 75:3727-3731 (1978).

(56) References Cited

OTHER PUBLICATIONS

Wells, J.A., et al., "Cassette mutagenesis: an efficient method for generation of multiple mutations at defined sites," Gene, 34:315-323 (1985).
Yi, S., et al., "Covalent immobilization of omega-transaminase from Vibrio fluvialis JS17 on chitosan beads," Process Biochemistry 42(5): 895-898 (2007).

ENGINEERED TRANSAMINASE POLYPEPTIDES FOR INDUSTRIAL BIOCATALYSIS

The present application is a national stage application filed under 35 USC §371 and claims priority to international application to PCT International Application No. PCT/US2014/018005, filed Feb. 24, 2014 which claims priority to U.S. Provisional Appln. Ser. No. 61/770,814, filed Feb. 28, 2013, both of which are incorporated by reference, in their entireties and for all purposes.

1. TECHNICAL FIELD

The disclosure relates to engineered transaminase polypeptides useful under industrial process conditions for the production of pharmaceutical and fine chemical amine compounds.

2. REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-129WO2_ST25.txt", a creation date of Jan. 29, 2014 and a size of 647,890 bytes. The Sequence Listing filed via EFS-Web is part of the specification and incorporated in its entirety by reference herein.

3. BACKGROUND

Transaminases (E.C. 2.6.1) catalyze the transfer of an amino group, a pair of electrons, and a proton from an amino donor compound to the keto group of an amino acceptor compound. Transaminase reactions can result in the formation of a chiral amine product compound. As shown in Scheme 1, an amino acceptor compound (B) (which is the keto substrate precursor of a desired chiral amine product (D)) is reacted with an amino donor compound (A) in the presence of a transaminase. The transaminase catalyzes the transfer of the primary amine group of the amino donor compound (A) to the keto group of the amino acceptor compound (B). The transaminase reaction results in a chiral amine product compound (D) (assuming $R^1$ is not the same as $R^2$) and a new amino acceptor byproduct (or "carbonyl byproduct") compound (C) which has a keto group.

Scheme 1

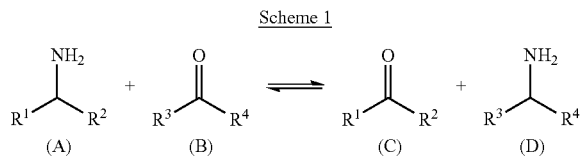

Chiral amine compounds are frequently used in the pharmaceutical, agrochemical and chemical industries as intermediates or synthons for the preparation of wide range of commercially desired compounds, such as cephalosporine or pyrrolidine derivatives. Typically these industrial applications of chiral amine compounds involve using only one particular stereomeric form of the molecule, e.g., only the (R) or the (S) enantiomer is physiologically active. Transaminases are highly stereoselective and have many potential industrial uses for the synthesis of optically pure chiral amine compounds.

Examples of the uses of transaminases to make chiral amine compounds include: the enantiomeric enrichment of amino acids (See e.g., Shin et al., 2001, Biosci. Biotechnol. Biochem. 65:1782-1788; Twasaki et al., 2003, Biotech. Lett. 25:1843-1846; Iwasaki et al., 2004. Appl. Microb. Biotech. 69:499-505, Yun et al., 2004, Appl. Environ. Microbiol. 70:2529-2534; and Hwang et al., 2004. Enzyme Microbiol. Technol. 34:429-426); the preparation of intermediates and precursors of pregabalin (e.g., WO 2008/127646); the enzymatic transamination of cyclopamine analogs (e.g., WO 2011/017551); the stereospecific synthesis and enantiomeric enrichment of β-amino acids (e.g., WO 2005/005633); the enantiomeric enrichment of amines (e.g., U.S. Pat. No. 4,950,606; U.S. Pat. No. 5,300,437; and U.S. Pat. No. 5,169,780); the production of amino acids and derivatives (e.g., U.S. Pat. No. 5,316,943; U.S. Pat. No. 4,518,692; U.S. Pat. No. 4,826,766; U.S. Pat. No. 6,197,558; and U.S. Pat. No. 4,600,692); and in the production of the pharmaceutical compounds, sitagliptin, rivastigmine, and vernakalant (See e.g. U.S. Pat. No. 8,293,507 B2, issued Oct. 23, 2012; Savile, et al., 2010, "Biocatalytic asymmetric synthesis of chiral amines from ketones applied to sitagliptin manufacture," Science 329(5989): 305-9; WO2011/159910, published Dec. 22, 2011; and WO2012/024104, published Feb. 23, 2012).

Wild-type transaminases having the ability to catalyze a reaction of Scheme 1 have been isolated from various microorganisms, including, but not limited to, *Alcaligenes denitrificans, Bordetella bronchiseptica, Bordetella parapertussis. Brucella melitensis, Burkholderia malle, Burkholderia pseudomallei, Chromobacterium violaceum, Oceanicola granulosus* HTCC2516, *Oceanobacter* sp. RED65, *Oceanospirillum* sp. MED92, *Pseudomonas putida, Ralstonia solanacearum, Rhizobium meliloti, Rhizohbium* sp. (strain NGR234), *Bacillus thuringensis, Klebsiella pneumonia, Vibrio fluvialis* (See e.g., Shin et al., 2001, Biosci. Biotechnol, Biochem. 65:1782-1788), and *Arthrobacter* sp. KNK168 (See e.g., Iwasaki et al., *Appl. Microbiol. Biotechnol.*, 2006, 69: 499-505, U.S. Pat. No. 7,169,592). Several of these wild-type transaminase genes and encoded polypeptides have been sequenced, including e.g., *Ralstonia solanacearum* (Genbank Acc. No. YP_002257813.1, GI:207739420). *Burkholderia pseudomallei* 1710b (Genbank Ace. No. ABA47738.1, GI:76578263), *Bordetella petrii* (Genbank Acc. No. AM902716.1, GI:163258032), *Vibrio fluvialis* JS17 (Genbank Acc. No. AEA39183.1, GI: 327207066), and *Arthrobacter* sp. KNK168 (GenBank Acc. No. BAK39753.1, GI:336088341). At least two wild-type transaminases of classes EC 2.6.1.18 and EC 2.6.1-19, have been crystallized and structurally characterized (See e.g., Yonaha et al., 1983, Agric. Biol. Chem. 47 (10):2257-2265).

Transaminases are known that have (R)-selective or (S)-selective stereoselectively. For example, the wild-type transaminase from *Arthrobacter* sp. KNK168 is considered (R)-selective and produces primarily (R)-amine compounds from certain substrates (See e.g., Iwasaki et al., *Appl. Microhiol. Biolechnol.*, 2006, 69: 499-505, U.S. Pat. No. 7,169,592), whereas the wild-type transaminase from *Vibrio fluvialis* JS17 is considered (S)-selective and produces primarily (S)-amine compounds from certain substrates (See e.g., Shin et al., "Purification, characterization, and molecular cloning of a novel amine:pyruvate transaminase from *Vibrio fluvialis* JS17," *Appl. Microbiol. Biotechnol.* 61 (5-6), 463-471 (2003)).

Non-naturally occurring transaminases having (R)-selectivity, increased solvent and thermal stability, and other improved properties for the conversion of a wide range of amino acceptor substrates, have been generated by mutagenesis and/or directed evolution of wild-type and other engineered transaminase backbone sequences (See e.g., U.S. Pat. No. 8,293,507 B2, issued Oct. 23, 2012; WO2011/005477A1, published Jan. 13, 2011; WO2012/024104, published Feb. 23, 2012; and Savile, et al., 2010, "Biocatalytic asymmetric synthesis of chiral amines from ketones applied to sitagliptin manufacture," Science 329(5989): 305-9).

However, transaminases generally have properties that are undesirable for commercial application in the preparation of chiral amine compounds, such as instability to industrially useful process conditions (e.g., solvent, temperature), poor recognition of, and stereoselectivity for, commercially useful amino acceptor and/or amino donor substrates, and low product yields due to unfavorable reaction equilibrium. Thus, there is a need for engineered transaminases that can be used in industrial processes for preparing chiral amines compounds in an optically active form.

4. SUMMARY

The present disclosure provides engineered polypeptides having transaminase activity, polynucleotides encoding the polypeptides, methods of the making the polypeptides, and methods of using the polypeptides for the biocatalytic conversion of amino acceptor substrate compounds (i.e., keto group containing compounds) to chiral amine product compounds. The transaminase polypeptides of the present disclosure have been engineered to have one or more residue differences as compared to a previously engineered transaminase polypeptide (of amino acid sequence SEQ ID NO:2) and associated enhanced solvent and thermal stability relative to previously engineered transaminase polypeptides (See e.g., U.S. Pat. No. 8,293,507 B2, issued Oct. 23, 2012; PCT Publication WO2011005477A1, published Jan. 13, 2011, and PCT publication WO2012024104, published Feb. 23, 2012). The amino residue differences are located at residue positions that result in improvement of various enzyme properties, including among others, activity, stereoselectivity, stability, expression, and product tolerance.

In particular, the engineered transaminase polypeptides of the present disclosure have been engineered for efficient conversion of the substrate, 4-oxo-4-[3-(trifluoromethyl)-5,6-dihydro[1,2,4]triazolo[4,3-a]pyrazin-7(8H)-yl]-1-(2,4,5-trifluorophenyl)butan-2-one (referred to herein as "compound (2)") to its corresponding chiral amine product compound, (2R)-4-oxo-4-[3-(trifluoromethyl)-5,6-dihydro[1,2,4]triazolo[4,3-a]pyrazin-7(8H)-yl]-1-(2,4,5-trifluorophenyl)butan-2-amine (referred to herein as "compound (1)") as shown in Scheme 2.

Scheme 2

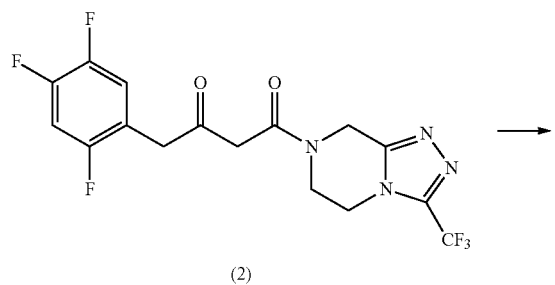

-continued

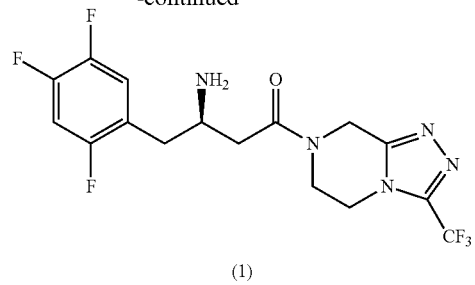

Compound (1), also known by the name "sitagliptin," is the active ingredient in JANUVIA®, a pharmaceutical product which has received marketing approval in the U.S. and other countries for the treatment of Type 2 diabetes.

The evolved structural features of the engineered transaminase polypeptides of the present disclosure, however, also allow for the biocatalytic conversion of a range of ketone substrate compounds of Formula (II) (including compounds other than compound (2)) to their corresponding chiral amine product compounds of Formula (I) (including compounds other than compound (1)) as shown in Scheme 3, Scheme 3

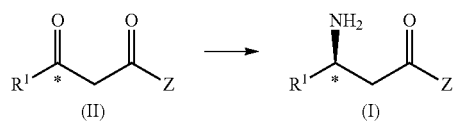

wherein

Z is $OR^2$ or $NR^2R^3$;

$R^1$ is $C_{1-8}$ alkyl, aryl, heteroaryl, aryl-$C_{1-2}$ alkyl, heteroaryl-$C_{1-2}$ alkyl, or a 5- to 6-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl, wherein alkyl and alkoxy are unsubstituted or substituted with one to five fluorines;

$R^2$ and $R^3$ are each independently hydrogen, $C_{1-8}$ alkyl, aryl, or aryl-$C_{1-2}$ alkyl; or $R^2$ and $R^3$ together with the nitrogen atom to which they are attached form a 4- to 7-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl, wherein alkyl and alkoxy are unsubstituted or substituted with one to five fluorines; and the heterocyclic ring system being optionally fused with a 5- to 6-membered saturated or aromatic carbocyclic ring system or a 5- to 6-membered saturated or aromatic heterocyclic ring system containing one to two heteroatoms selected from O, S, and N, the fused ring system being unsubstituted or substituted with one to two substituents selected from hydroxy, amino, fluorine, $C_{1-4}$ alkyl, $C_{1-4}$ alkoxy, and trifluoromethyl.

In some embodiments, the engineered transaminase polypeptide are capable of biocatalytic conversion of compounds of Formula (II) to compounds of Formula (I) having the indicated stereochemical configuration at the stereogenic center marked with an *; in an enantiomeric excess of at least 70% over the opposite enantiomer.

In some embodiments, the present disclosure provides an engineered polypeptide having transaminase activity comprising an amino acid sequence having at least 80% sequence identity to reference sequence of SEQ ID NO:2 and (a) an amino acid residue difference as compared to SEQ ID NO:2 selected from X33L, X36C, X41/C/F/K/M/N/R, X42G, X48D/E/G/K/T, X51K, X54P, X76S, X122F/Q, X148Q, X152T, X155A/I/K/T/V, X156R, X160P, X215G/H/L, X241R, X270T, X273H, X325M; and X241R, and/or (b) a combination of residue differences selected from: X42G, X54P, X152S, and X155T; X42G, X54P, X152S, X155T, and R164P; X42G, X54P, X150F, X152S, and X155T; X42G, X54P, X150F, X152S, X155T, and X267V; X42G, X54P, X150F, X152S. X155L. W156Q, and C215G; X42G, X54P, X150F, X152S, X155T, X215G, and X267V; X33L; X42G, X54P, X117G; X150F, X152S, X155I, X156Q, and C215G; and X41K, X42G, X54P, X150F, X152S, X155K, X156Q, and C215G; X33L, X42G, X54P, X109S, X150F, X152S, X155K, X156Q, and X215H; X33L, X42G, X54P, X150F, X152S, X155I, X156Q, and X215G; X33L, X42G, X54P, X150F, X152S, X155K, X156Q, and X215H; X33L, X42G, X54P, X150F, X152S, X155L, X156Q, and X215H; X33L, X42G, X54P, X150F, X152S, X155L, X156Q, X215H, and X241R; X41F, X42G, X54P, X122Q, X150F, X152T, X155V, X156Q, and X215G; X41F, X42G, X54P, X150F, X152S, X155L, X156Q, X171I, X215G, and X241R; X41F, X42G, X54P, X150F, X152S, X155I, X156Q, V171I, and X215G; X41F, X42G, X54P, X150F, X152S, X155I, X156Q, and X215G; X41F, X42G, X54P, X150F, X152S, X155L, X156Q, X171I, and X215G; X41F, X42G, X54P, X150F, X152S, X155L, X156Q, and X215G; X42G, X48G, X54P, X150F, X152S, X155L, X156Q, and X215H; X42G, X54P, X60V, X150F, X152S, X155L, X156Q, and X215G; X42G, X54P, X68A, X150F, X152S, X155L, X156Q, and X215G; X42G, X54P, X69S, X150F, X152S, X155L, X156Q, and X215G; X42G, X54P, X122Q, X150F, X152S, X155I, X156Q, X215G, and X241R; X42G, X54P, X122Q, X150F, X152S, X155L, X156Q, X171I, X215G, and X241R; X42G, X54P, X122Q, X150F, X152T, X155V, X156Q, X171I, X215G, and X241R; X42G, X54P, X126M, X150F, X152S, X155L, X156Q, and X215G; X42G, X54P, X135I, X136Y, X150F, X152S, X155L, X156Q, X192F, and X215G; X42G, X54P, X136I, X150F, X152S, X155L, X156Q, and X215G; X42G, X54P, X136I, X150F, X152S, X155L, X156Q, X215G, and X224I; X42G, X54P, X136I, X150F, X152S, X155L, X156Y, X215G, X282V, and X284I; X42G, X54P, X136I, X150F, X152S, X155L, X156Y, X215G, and X284P; X42G, X54P, X136Y, X150F, X152S, X155L, X156Q, X215G, X282V, and X284P; X42G, X54P, X150F, X152S, X155I, X156Q, X171I, X215G, and X241R; X42G, X54P, X150F, X152S, X155L, X156Q, X193M, and X215G; X42G, X54P, X150F, X152S, X155L, X156Q, X215G, X282V, and X284I; X42G, X54P, X150F, X152S, X155L, X156Q, X215G, and X283S; X42G, X54P, X150F, X152S, X155L, X156Q, X215G, and X284I; and X42G, X54P, X150F, X152S, X155L, X156Y, and X215G.

In some embodiments of the engineered polypeptides having transaminase activity of the present disclosure, the amino acid sequence can further comprise one or more residue differences as compared to SEQ ID NO:2 selected from: X5K, X33L, X36C, X41C/F/K/M/N/R, X42A/G, X44Q, X48D/E/G/K/T, X49T, X51K, X54P, X55L, X76S, X108V, X117G, X122F/Q, X126A, X148Q, X150A/F, X152S/T, X155A/K/L/TV, X156Q/R/S, X160P, X164P, X165N, X182T, X215G/H/L, X218M, X241R, X267V, X270T, X273H, X325M, and X328I.

In some embodiments, the present disclosure provides an engineered polypeptide having transaminase activity comprising an amino acid sequence having at least 80% sequence identity to reference sequence of SEQ ID NO:2 and (a) an amino acid residue difference as compared to SEQ ID NO:2 selected from G36C, I41C, I41F, I41K, I41M, I41N, I41R, E42G, P48D, P48E, P48G, P48K, P48T, A51K, S54P, M122F, M122Q, Y148Q, C152T, Q155A, Q155I, Q155K, Q155T, Q155V, C215H, C215L, Y273H, L325M, and A241R; or (b) a combination of residue differences selected from; A5K, E42G, S49T, S54P, C152S, Q155T, and W156Q; P33L, I41C, E42G, S54P, S150F, C152S, Q155K, F160P, and C215G; P33L, I41K, E42G, S54P, S150F, C152S, Q155I, F160P, and C215L; P33L, E42G, P48G, S54P, S150F, C152S, Q155T, and C215H; P33L, E42G, S54P, A109S, S150F, C152S, Q155K, W156Q, and C215H; P33L, E42G, S54P, E117G, S150F, C152S, Q155I, W156Q, and C215G; P33L, E42G, S54P, S150F, C152S, Q155I, W156Q, and C215G; P33L, E42G, S54P, S150F, C152S, Q155K, W156Q, and C215H; P33L, E42G, S54P, S150F, C152S, Q155L, W156Q, and C215H; P33L, E42G, S54P, S150F, C152S, Q155L, W156Q, C215H, and A241R; G36C, E42G, P48G, S54P, S150F, C152S, Q155I, and C215H; G36C, E42G, P48K, S54P, S150F, C152S, Q155T, and C215H; G36C, E42G, S54P, S150F, C152S, Q155I, C215H, and A241R; G36C, E42G, S54P, S150F, C152S, Q155K, C215H, and A241R; G36C, E42G, S54P, S150F, C152S, Q155T, and A241R; G36C, E42G, S54P, S150F, C152S, Q155V, and C215H; I41C, E42G, S49T, S54P, S150F, C152S, Q155I, F160P, C215G, and I267V; I41C, E42G, S49T, S54P, S150F, C152S, Q155K, W156Q, C215G and I267V; I41C, E42G, S54P, I108V, S150F, C152S, and Q155K; I41C, E42G, S54P, I108V, S150, C152S, Q155K, W156Q, C215G, and I267V; I41C, E42G, S54P, I108V, S150F, C152S, Q155T, W156Q, and C215G; I41C, E42G, S54P, E117G, S150F, C152S, Q155K, and F160P; I41C, E42G, S54P, E117G, S150F, C152S, Q155K, and C215L; I41C, E42G, S54P, E117G, S150F, C152S, Q155L, and C215L; I41C, E42G, S54P, S150F, C152S, Q155I, and C215G; I41C, E42G, S54P, S150F, C152S, Q155I, and C215L; I41C, E42G, S54P, S150F, C152S, Q155K, W156Q, C215G, and I267V; I41C, E42G, S54P, S150F, C152S, Q155K, and C215L; I41C, E42G, S54P, S150F, C152S, Q155K, and C215G; I41C, E42G, S54P, S150F, C152S, Q155L, F160P, C215G, and I267V; I41C, E42G, S54P, S150, C152S, Q155T, W156Q, F160P, and C215L; I41C, E42G, S54P, S150F, C152S, Q155T, W156Q, and C215L; I41F, E42G, S54P, M122Q, S150F, C152T, Q155V, W156Q, and C215G; I41F, E42G, S54P, S150F, C152S, Q155L, W156Q, V171I, and C215G; I41F, E42G, S54P, S150F, C152S, Q155L, W156Q, V171I, C215G, and A241R, I41F, E42G, S54P, S150F, C152S, Q155I, W156Q, and C215G; I41K, E42G, P48E, S54P, S150F, C152S, Q155K, and W156Q; I41K, E42G, P48E, S54P, S150F, C152S, Q155L, and C215L; I41K, E42G, S54P, I108V, E117G, S150, C152S, Q155K, and C215L; I41K, E42G, S54P, I108V, S150, C152S, Q155T, and C215G; I41K, E42G, S54P, E117G, S150F, C152S, Q155L, and C215G; I41K, E42G, S54P, E117G, S150F, C152S, Q155K, C215L, and I267V; I41K, E42G, S54P, S150F, C152S, Q155K, W156Q, and C215G; I41K, E42G, S54P, S150F, C152S, Q155K, F160P, C215G, and I267V; I41K, E42G, S54P, S150F, C152S, Q155K, and C215L; I41K, E42G, S54P, S150F, C152S, and Q155T; I41K, E42G, S54P, S150F, C152S, Q155T, and F160P; I41K, E42G, S54P, S150F, C152S, Q155T, and C215G; I41K, E42G, S54P, S150F, C152S, Q155T, C215G, and I267V; I41K, E42G, S54P, S150F, C152S, Q155K, W156Q, and C215G; I41N, E42G, S54P, S150, C152S, Q155I, and F160P; I41N, E42G, S54P, E117G, S150F, C152S, Q155T; and W156Q; I41N, S49T, E42G, S54P, S150F, C152S, Q155L, F160P, D165N, and C215L; E42A, A44Q, S54P, I108V, S150F, C152S, Q155T, and I267V; E42G, A44Q, S54P, I108V, S150F, C152S, and Q155T; E42G, A44Q, S54P, I108V, S150F, C152S, Q155T, and I267V; E42G, A44Q, S54P, S150A, C152S, and Q155T; E42G, A44Q, S54P, S150F, C152S, and Q155T; E42G, P48G, S54P, S150F, C152S, Q155L, W156Q, and C215H; E42G, P48G, S54P, S150, C152S, and Q155T; E42G, S49T, S54P, I108V, E117G, S150F, C152S, Q155L, F160P, and C215L; E42G, S49T, S54P, I108V, E117G, S150F, C152S, Q155K, W156Q, and C215G; E42G, S49T, S54P, I108V, E117G, S150F, C152S, Q155T, W156Q, C215G, and I267V; E42G, S49T, S54P, C152S, Q155T, and W156Q; E42G, S54P, I55L, T126A, C152S, Q155T, L218M, and A270T; E42G, S54P, F60V, S150F, C152S, Q155L, W156Q, and C215G; E42G, S54P, T68A, S150F, C152S, Q155L, W156Q, and C215G; E42G, S54P, T69S, S150F, C152S, Q155L, W156Q, and C215G; E42G, S54P, N76S, T126A, C152S, Q155T, S182T, L218M, A270T, and V328I; E42G, S54P, I108V, S150F, C152S, Q155K, and C215H; E42G, S54P, I108V, S150, C152S, and Q155T; E42G, S54P, I108V, S150F, C152S, Q155T, and I267V; E42G, S54P, I108V, S150, C152S, Q155V, W156Q, and F160P; E42G, S54P, E117G, C152S, and Q155T; E42G, S54P, E117G, C152S, Q155T, and W156Q; E42G, S54P, M122Q, S150F, C152S, Q155I, W156Q, C215G, and A241R; E42G, S54P, M122Q, S150F, C152S, Q155L, W156Q, V171I, C215G, and A241R; E42G, S54P, M122Q, S150F, C152T, Q155V, W156Q, V171I, C215G, and A241R; E42G, S54P, T126M, S150F, C152S, Q155L, W156Q, and C215G; E42G, S54P, P135I, F136Y, S150F, C152S, Q155L, W156Q, W192F, and C215G; E42G, S54P, F136I, S150F, C152S, Q155L, W156Q, and C215G; E42G, S54P, F136I, S150F, C152S, Q155L, W156Q, C215G, and G224I; E42G, S54P, F136I, S150F, C152S, Q155L, W156Y, C215G, S282V, and G284I; E42G, S54P, F136I, S150F, C152S, Q155L, W156Y, C215G, and G284P; E42G, S54P, F136Y, S150F, C152S, Q155L, W156Q, C215G, S282V, and G284P; E42G, S54P, S150A, C152S, Q155T, and I267V; E42G, S54P, S150F, C152S, Q155I, W156Q, F160P, C215L, and I267V; E42G, S54P, S150F, C152S, Q155I, W156Q, V171I, C215G, and A241R; E42G, S54P, S150F, C152S, Q155I, W156Q, and C215L; E42G, S54P, S150F, C152S, Q155I, F160P, and C215G; E42G, S54P, S150F, C152S, Q155I, and C215H; E42G, S54P, S50F, C152S, Q155K, and W156Q; E42G, S54P, S50F, C152S, Q155K, W156Q, and I267V; E42G, S54P, S150F, C152S, Q155L, W156Q, G193M, and C215G; E42G, S54P, S50F, C152S, Q155L, W156Q, and C215G; E42G, S54P, S150F, C152S, Q155L, W156Q, C215G, S282V, and G284I; E42G, S54P, S150F, C152S, Q155L, W156Q, C215G, and T283S; E42G, S54P, S150F, C152S, Q155L, W156Q, C215G, and G284I; E42G, S54P, S150F, C152S, Q155L, W156Y, and C215G; E42G, S54P, S150, C152S, Q155L, and C215H; E42G, S54P, S150F, C152S, and Q155T; E42G, S54P, S150F, C152S, Q155T, C215G, and I267V; E42G, S54P, S150F, C152S, Q155T, and I267V; E42G, S54P, S150F, C152S, Q155T, W156Q, F160P, C215L, and I267V; E42G, S54P, S150F, C152S, Q155T, W156Q, C215G, and I267V; E42G, S54P, S150F, C152S, Q155T, and W156R; E42G, S54P, S150F, C152S, Q155T, F160P, and C215G; E42G, S54P, S150F, C152S, Q155T, F160P, and C215L; E42G, S54P, S150F, C152S, Q155T, C215G, and I267V; E42G, S54P, S150F, C152S, Q155T, and I267V; E42G, S54P, C152S, Q155I, and W156S; E42G, S54P, C152S, Q155K, and W156S; E42G, S54P, C152S, Q155L, and W156S; E42G, S54P, C152S, and Q155T; E42G, S54P, C152S, Q155T, and F160P; E42G, S54P, C152S, Q155T, and R164P; E42G, S54P, C152S, Q155T, and W156Q; E42G, S54P, C152S, Q155T, and W156S; E42G, S54P, C152S, Q155T, and R164P; E42G, S54P, C152S, Q155T, S182T, L218M, and A270T; E42G, S54P, C152S, Q155T, and C215G; E42G, S54P, C152S, Q155T, and C215L; and E42G, S54P, C152S, Q155V, and W156S.

In some embodiments of the engineered polypeptides having transaminase activity of the present disclosure, the engineered polypeptide is capable of converting a substrate of compound (2) to a product of compound (1) under suitable reaction conditions. In some embodiments, the engineered polypeptide is capable of converting compound (2) to compound (1) with at least 1.2 fold, 2 fold, 5 fold, 10 fold, 20 fold, 25 fold, 50 fold. 75 fold, 100 fold, or greater the activity of SEQ ID NO:2 under suitable reaction conditions. In some embodiments, the engineered polypeptide is capable of converting compound (2) to compound (1) with increased activity relative to SEQ ID NO:2 in which the suitable reaction conditions comprise compound (1) at a loading of at least 50 g/L, 1 mM PLP, 50% DMSO (v/v), 1.5 M isopropylamine, pH 11, and 55° C.

In some embodiments of the present disclosure, the amino acid sequence of the engineered polypeptide comprises a sequence selected from the following exemplary sequences of SEQ ID NO:4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, and 306. Each of these exemplary polypeptide sequences comprises a different combination of the amino acid differences relative to SEQ ID NO:2 as disclosed herein (See e.g., Tables 2A, 2B, and 2C). In some embodiments, the engineered polypeptide comprises a sequence having at least 80%, 85%, 86%, 87%, 88%, 89%, 90%, 91%, 92%, 93%, 94%, 95%, 96%, 97%, 98%, 99% or more identity to any one of these exemplary sequences, and further comprising a combination of amino acid differences relative to SEQ ID NO:2, as found in any one of these exemplary amino acid sequences. In some embodiments, the engineered polypeptide comprising a combination of amino acid differences relative to SEQ ID NO:2, as found in any one of these exemplary amino acid sequences can further comprise additional amino acid differences as compared to SEQ ID NO:2 selected from: X5K, X33L, X36C, X41C/F/K/M/N/R, X42A/G, X44Q, X48D/E/G/K/T, X49T, X51K, X54P, X55L, X76S, X108V, X117G, X122F/Q, X126A, X148Q, X150A/F, X152S/T, X155A/I/K/L/T/V, X156Q/R/S, X160P, X164P, X165N, X182T, X215G/H/L, X218M, X241R, X267V, X270T, X273H, X325M, and X328I; or other amino acid differences disclosed in the art of engineered transaminase polypeptides (See e.g., amino acid differences disclosed in U.S. Pat. No. 8,293,507 B2, issued Oct. 23, 2012; WO2011/005477A1, published Jan. 13, 2011; WO2012/024104, published Feb. 23, 2012.)

In some embodiments of the present disclosure, the engineered polypeptide having transaminase activity is immobilized on a solid support, optionally wherein the solid support is selected from a bead or resin comprising polymethacrylate with epoxide functional groups, polymethacrylate with amino epoxide functional groups, styrene/DVB copolymer or polymethacrylate with octadecyl functional groups.

In other aspects, the present disclosure provides a polynucleotide encoding the engineered polypeptide having transaminase activity disclosed herein. In some embodiments, the polynucleotide can comprise a nucleotide sequence selected from SEQ ID NO:3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 375, 277, 279, 281, 283, 285, 287, 291, 293, 295, 297, 299, 301, 303, and 305.

Further, the present disclosure provides expression vectors and host cells comprising a polynucleotide encoding the engineered polypeptide having transaminase activity disclosed herein. Thus, in some embodiments, the present disclosure provides an expression vector comprising the polynucleotide encoding an engineered polypeptide as disclosed herein, and optionally further comprising a control sequence. In other embodiments, the present disclosure provides a host cell comprising a polynucleotide encoding an engineered polypeptide as disclosed herein. In other embodiments, the present disclosure provides a host cell comprising an expression vector, wherein the expression vector comprises a polynucleotide encoding an engineered polypeptide as disclosed herein. In other embodiments, of the present disclosure provides a method of preparing an engineered polypeptide as disclosed herein, wherein the method comprises culturing a host cell of under conditions suitable for expression of the polypeptide. In some embodiments, the method of preparing the engineered polypeptide further comprises isolating the polypeptide.

The present disclosure also provides processes for using the engineered transaminase polypeptides disclosed herein for the preparation of wide range of chiral amine compounds. In some embodiments, the present disclosure provides a method for preparing a compound of structural Formula (I):

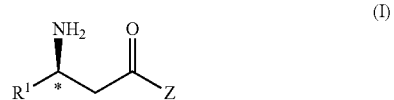

having the indicated stereochemical configuration at the stereogenic center marked with an *; in an enantiomeric excess of at least 70% over the opposite enantiomer, wherein
Z is $OR^2$ or $NR^2R^3$;
$R^1$ is $C_{1-8}$ alkyl, aryl, heteroaryl, aryl-$C_{1-2}$ alkyl, heteroaryl-$C_{1-2}$ alkyl, or a 5- to 6-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl, wherein alkyl and alkoxy are unsubstituted or substituted with one to five fluorines;
$R^2$ and $R^3$ are each independently hydrogen, $C_{1-8}$ alkyl, aryl, or aryl-$C_{1-2}$ alkyl; or
$R^2$ and $R^3$ together with the nitrogen atom to which they are attached form a 4- to 7-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl, wherein alkyl and alkoxy are unsubstituted or substituted with one to five fluorines; and the heterocyclic ring system being optionally fused with a 5- to 6-membered saturated or aromatic carbocyclic ring system or a 5- to 6-membered saturated or aromatic heterocyclic ring system containing one to two heteroatoms selected from O, S, and N, the fused ring system being unsubstituted or substituted with one to two substituents selected from hydroxy, amino, fluorine, $C_{1-4}$ alkyl, $C_{1-4}$ alkoxy, and trifluoromethyl; the process comprising the step of contacting a prochiral ketone of structural Formula (II):

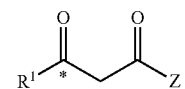

with an engineered polypeptide as disclosed herein in the presence of an amino group donor in a suitable organic solvent under suitable reaction conditions.

In some embodiments of the process for preparing a compound of structural Formula (I), $R^1$ is benzyl and the phenyl group of benzyl is unsubstituted or substituted one to three substituents selected from the group consisting of fluorine, trifluoromethyl, and trifluoromethoxy. In some embodiments of the process, Z is $NR^2R^3$, wherein $NR^2R^3$ is a heterocycle of the structural Formula (III):

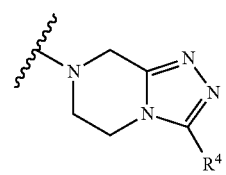

wherein $R^4$ is hydrogen or $C_{1-4}$ alkyl which is unsubstituted or substituted with one to five fluorines.

In some embodiments of the process for preparing a compound of structural Formula (I), the compound of Formula (II) specifically excludes compound (2) and the compound of Formula (I) prepared by the method specifically excludes compound (1).

In some embodiments, the present disclosure provides process for preparing a compound of structural Formula (Ia):

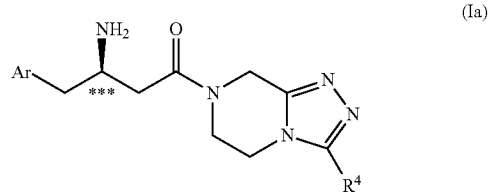

having the (R)-configuration at the stereogenic center marked with an ***; in an enantiomeric excess of at least 70% over the enantiomer having the opposite (S)-configuration; wherein Ar is phenyl which is unsubstituted or substituted with one to five substituents independently selected from the group consisting of fluorine, trifluoromethyl, and trifluoromethoxy; and $R^4$ is hydrogen or $C_{1-4}$ alkyl unsubstituted or substituted with one to five fluorines; the process comprising the step of:

contacting a prochiral ketone of structural Formula (IIa):

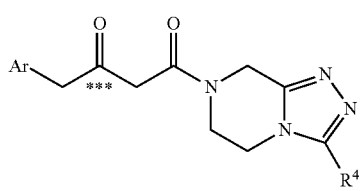

(IIa)

with an engineered polypeptide as disclosed herein in the presence of an amino group donor under suitable reaction conditions. In some embodiments of the process for preparing the compound of Formula (Ia), Ar is selected from 2,5-difluorophenyl or 2,4,5-trifluorophenyl, and $R^4$ is trifluoromethyl.

In some embodiments of the process for preparing a compound of structural Formula (Ia), the compound of Formula (IIa) specifically excludes compound (2) and the compound of Formula (Ia) prepared by the method specifically excludes compound (1).

In some embodiments, the present disclosure provides a process of preparing compound (1)

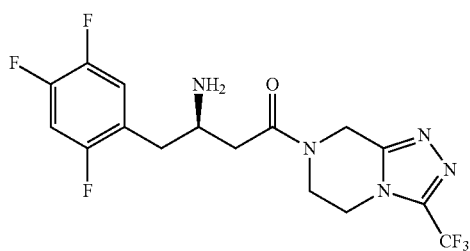

(1)

comprising a step of contacting a substrate of compound (2)

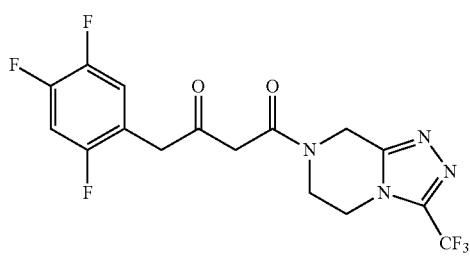

(2)

with an engineered polypeptide as disclosed herein in the presence of an amino group donor under suitable reaction conditions.

In some embodiments, the present disclosure also provides a process of preparing compound (3), gemigliptin,

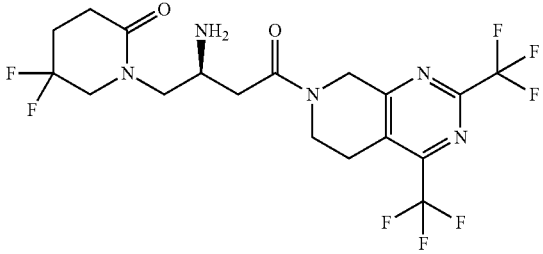

(3)

comprising a step of contacting a substrate of compound (4), or a substrate of compound (4) modified with a protecting group,

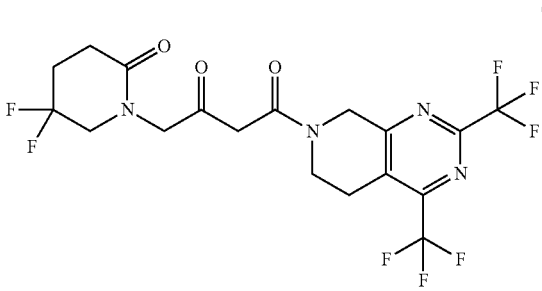

(4)

with an engineered polypeptide as disclosed herein in the presence of an amino group donor under suitable reaction conditions.

In some embodiments, the processes using the engineered polypeptides disclosed herein can be carried out wherein the chiral amine compound of Formula (I), the compound of Formula (Ia), the compound (1), or the compound (3), is produced in at least 90%, 97%, 98%, 99% or greater enantiomeric excess.

Any of the processes disclosed herein using the engineered polypeptides for the preparation of compounds of Formula (I), compounds of Formula (Ia), compound (1), or compound (3) can be carried out under a range of suitable reaction conditions, including but not limited to, ranges of amine donor, pH, temperature, buffer, solvent system, substrate loading, polypeptide loading, cofactor loading, pressure, and reaction time. For example, in some embodiments, the preparation of compounds of Formula (I), compounds of Formula (Ia), compound (1), or compound (3) can be carried out wherein the suitable reaction conditions comprise: (a) substrate loading of about 10 to 200 g/L of substrate compound (e.g., compound (2)); (b) of about 0.5 g/L to 5 g/L engineered polypeptide; (c) IPM concentration of about 0.1 to 3 M; (d) PLP cofactor concentration of about 0.1 to 1 mM; (e) DMSO concentration of about 30% (v/v) to about 60% (v/v); (f) pH of about 9.5 to 11.5; and (g) temperature of about 45° C. to 60° C. In some embodiments, the suitable reaction conditions comprise: (a) about 50 g/L of substrate compound (e.g., compound (2)); (b) about 2 g/L engineered polypeptide; (c) about 50% (v/v) dimethylsulfoxide (DMSO); (d) about 1 M isopropylamine (IPM); (e) about 1 mM pyridoxal phosphate (PLP); (f) about pH 10; and (g) about 50° C.

In some embodiments, the processes using the engineered polypeptides disclosed herein can be carried out wherein the amino group donor is selected from isopropylamine, alanine, 3-aminobutyric acid, or methylbenzylamine. In some embodiments, the amino group donor is isopropylamine.

In some embodiments, the processes using the engineered polypeptides disclosed herein can be carried out wherein the process comprises further steps of isolating the product compounds of Formula (I), Formula (Ia), compound (1), or compound (3), from the reaction.

In some embodiments, the processes using the engineered polypeptides disclosed herein can be carried out wherein the process further comprises the step of converting the compound of Formula (I), compound of Formula (Ia), the compound (1) or the compound (3) into a pharmaceutically acceptable salt. In some embodiments, the process of forming the pharmaceutically acceptable salt comprises the further step of contacting said compound with a pharmaceutically acceptable acid in a suitable reaction solvent. In some embodiments of the process, the pharmaceutically acceptable acid is phosphoric acid and the pharmaceutically acceptable salt is the dihydrogen phosphate salt. In some embodiments, the processes can further comprise the step of crystallizing the pharmaceutically acceptable salt from the reaction solvent.

As noted above, the compound (1) is sitagliptin, the active pharmaceutical ingredient in JANUVIA®. Accordingly, the processes disclosed herein using engineered polypeptides for making compound (1), and/or its pharmaceutically acceptable salt or acid, can be used in larger processes for the production of JANUVIA® or related pharmaceutical compounds. In some embodiments the present disclosure also provides a process for the preparation of (2R)-4-oxo-4-[3-(trifluoromethyl)-5,6-dihydro[1,2,4]triazolo[4,3-a]pyrazin-7(8H)-yl]-1-(2,4,5-trifluorophenyl)butan-2-amine phosphate (1:1) monohydrate, wherein the process comprises a step of converting a substrate compound (2) to a product compound (1) by contacting a substrate of compound (2) with an engineered polypeptide as disclosed herein in the presence of an amino group donor under suitable reaction conditions.

Similarly, the present disclosure provides a process for the preparation of compound (3), or a pharmaceutically acceptable salt or acid of compound (3), wherein the process comprises a step of converting a substrate compound (4), or a substrate of compound (4) modified with a protecting group, to a product compound (3), by contacting a substrate of compound (4), or a substrate of compound (4) modified with a protecting group, with an engineered polypeptide as disclosed herein in the presence of an amino group donor under suitable reaction conditions.

Further guidance on the choice of engineered polypeptides, their preparation, the choice of substrates, and parameters for carrying out the processes are further described in the more detailed description and Examples that follow.

5. DETAILED DESCRIPTION

As used in this specification and the appended claims, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," "including," "have," and "having" are interchangeable and not intended to be limiting.

It is to be understood that where descriptions of various embodiments use the term "comprising," those skilled in the art would understand that in some specific instances, an embodiment can be alternatively described using language "consisting essentially of" or "consisting of."

It is to be further understood that both the foregoing general description, including the drawings, and the following detailed description are exemplary and explanatory only and are not restrictive of this disclosure.

The section headings used herein are for organizational purposes only and not to be construed as limiting the subject matter described.

5.1 ABBREVIATIONS

The abbreviations used for the genetically encoded amino acids are conventional and are as follows:

| Amino Acid | Three-Letter Abbreviation | One-Letter Abbreviation |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | HIS | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleotides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

5.2 DEFINITIONS

In reference to the present disclosure, the technical and scientific terms used in the descriptions herein will have the meanings commonly understood by one of ordinary skill in the art, unless specifically defined otherwise. Accordingly, the following terms are intended to have the following meanings:

"Protein", "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

"Transaminase" or "aminotransferase" are used interchangeably herein to refer to a polypeptide having an enzymatic capability of transferring an amino group (—NH$_2$), a pair of electrons, and a proton from the primary amine of an amine donor compound to the carbonyl group (C=O) of an amine acceptor compound, thereby converting the amine donor compound into its corresponding carbonyl compound and the carbonyl acceptor compound into its corresponding primary amine compound (See e.g., Scheme 1). Transaminases as used herein include naturally occurring (wild type) transaminase as well as non-naturally occurring engineered polypeptides generated by human manipulation.

"Amino group donor" or "amino donor" used interchangeably herein to refer to an amino group containing compound which is capable of donating an amino group to an acceptor carbonyl compound (i.e., an amino group acceptor), thereby becoming a carbonyl by-product. Amino group donors have the general structural formula,

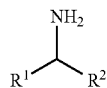

in which each of R$^1$, and R$^2$, when taken independently, is an alkyl, an alkylaryl group, or aryl group which is unsubstituted or substituted with one or more enzymatically non-inhibiting groups. R$^1$ can be the same or different from R$^2$ in structure or chirality. The groups R$^1$ and R$^2$, taken together, may form a ring that is unsubstituted, substituted, or fused to other rings. Typical amino group donors include chiral and achiral amino acids, and chiral and achiral amines.

"Chiral amine" refers to amines of general formula R$^\alpha$—CH(NH$_2$)—R$^\beta$ and is employed herein in its broadest sense, including a wide variety of aliphatic and alicyclic compounds of different, and mixed, functional types, characterized by the presence of a primary amino group bound to a secondary carbon atom which, in addition to a hydrogen atom, carries either (i) a divalent group forming a chiral cyclic structure, or (ii) two substituents (other than hydrogen) differing from each other in structure or chirality. Divalent groups forming a chiral cyclic structure include, for example, 2-methylbutane-1,4-diyl, pentane-1,4-diyl, hexane-1,4-diyl, hexane-1,5-diyl, 2-methylpentane-1,5-diyl. The two different substituents on the secondary carbon atom (R$^\alpha$ and R$^\beta$ above) also can vary widely and include alkyl, arylalkyl, aryl, halo, hydroxy, lower alkyl, lower alkyloxy, lower alkylthio, cycloalkyl, carboxy, carbalkyloxy, carbamoyl, mono- and di-(lower alkyl) substituted carbamoyl, trifluoromethyl, phenyl, nitro, amino, mono- and di-(lower alkyl) substituted amino, alkylsulfonyl, arylsulfonyl, alkylcarboxamido, arylcarboxamido, etc., as well as alkyl, arylalkyl, or aryl substituted by the foregoing.

"Carbonyl by-product" refers to the carbonyl compound formed from the amino group donor when the amino group on the amino group donor is transferred to the amino group acceptor in a transamination reaction. The carbonyl by-product has the general structural formula,

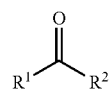

wherein R$^1$ and R$^2$ are defined above for the amino group donor.

"Amino acceptor" and "amine acceptor," "keto substrate," are used interchangeably herein to refer to a carbonyl group containing compound that accepts the amino group from an amino group donor in a reaction mediated by a transaminase (See e.g., Scheme 1). In the context of the present disclosure, the amino acceptor compound for the transaminase can include, among others, the compound of Formula (II), the compound of Formula (IIa), the compound (2), and the compound (4), as further described herein.

"Cofactor," as used herein, refers to a non-protein compound that operates in combination with an enzyme in catalyzing a reaction. As used herein, "cofactor" is intended to encompass the vitamin B$_6$ family compounds PLP, PN, PL, PM, PNP, and PMP, which are sometimes also referred to as coenzymes.

"Pyridoxal-phosphate," "PLP," "pyridoxal-5'-phosphate." "PYP," and "P5P" are used interchangeably herein to refer to the compound that acts as a cofactor in transaminase reactions. In some embodiments, pyridoxal phosphate is defined by the structure 1-(4'-formyl-3'-hydroxy-2'-methyl-5'-pyridyl)methoxyphosphonic acid, CAS number [54-47-7]. Pyridoxal-5'-phosphate can be produced in vivo by phosphorylation and oxidation of pyridoxol (also known as Vitamin B$_6$). In transamination reactions using transaminase enzymes, the amine group of the amino donor is transferred to the cofactor to produce a keto byproduct, while pyridoxal-5'-phosphateconverted to pyridoxamine phosphate. Pyridoxal-5'-phosphateregenerated by reaction with a different keto compound (the amino acceptor). The transfer of the amine group from pyridoxamine phosphate to the amino acceptor produces an amine and regenerates the cofactor. In some embodiments, the pyridoxal-5'-phosphate can be replaced by other members of the vitamin B$_6$ family, including pyridoxine (PN), pyridoxal (PL), pyridoxamine (PM), and their phosphorylated counterparts; pyridoxine phosphate (PNP), and pyridoxamine phosphate (PMP).

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman, 1981. Adv. Appl. Math. 2:482, by the homology alignment algorithm of Needleman and Wunsch, 1970, J. Mol. Biol. 48:443, by the search for similarity method of Pearson and Lipman, 1988, Proc. Natl. Acad. Sci. USA 85:2444, by computerized implementations of these algorithms (GAP. BESTFIT, FASTA, and TFASTA in the GCG Wisconsin Software Package), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)). Examples of algorithms that are suitable for determining percent sequence identity and sequence similarity are the BLAST and BLAST 2.0 algorithms, which are described in Altschul et al., 1990. J. Mol. Biol. 215: 403-410 and Altschul et al., 1977, Nucleic Acids Res. 3389-3402, respectively. Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989, Proc Natl Acad Sci USA 89:10915). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, a "reference sequence based on SEQ ID NO:2 having at the residue corresponding to X9 a histidine" refers to a reference sequence in which the corresponding residue at X9 in SEQ ID NO:2, which is a tyrosine, has been changed to histidine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered transaminase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X12 as compared to SEQ ID NO:2" refers to a difference of the amino acid residue at the polypeptide position corresponding to position 12 of SEQ ID NO:2. Thus, if the reference polypeptide of SEQ ID NO:2 has a tyrosine at position 12, then a "residue difference at position X12 as compared to SEQ ID NO:2" an amino acid substitution of any residue other than tyrosine at the position of the polypeptide corresponding to position 12 of SEQ ID NO:2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in Tables 2A, 2B, and 2C), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X192A/X192G). The present disclosure includes engineered polypeptide sequences comprising one or more amino acid differences that include either/or both conservative and non-conservative amino acid substitutions.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, and isoleucine; an amino acid with hydroxyl side chain is substituted with another amino acid with a hydroxyl side chain, e.g., serine and threonine; an amino acids having aromatic side chains is substituted with another amino acid having an aromatic side chain, e.g., phenylalanine, tyrosine, tryptophan, and histidine; an amino acid with a basic side chain is substituted with another amino acid with a basis side chain, e.g., lysine and arginine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively. Exemplary conservative substitutions are provided in Table 1 below:

TABLE 1

| Residue    | Possible Conservative Substitutions |
|------------|-------------------------------------|
| A, L, V, I | Other aliphatic (A, L, V, I)        |
|            | Other non-polar (A, L, V, I, G, M)  |
| G, M       | Other non-polar (A, L, V, I, G, M)  |
| D, E       | Other acidic (D, E)                 |
| K, R       | Other basic (K, R)                  |
| N, Q, S, T | Other polar                         |
| H, Y, W, F | Other aromatic (H, Y, W, F)         |
| C, P       | None                                |

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered transaminase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered transaminase enzymes comprise insertions of one or more amino acids to the naturally occurring transaminase polypeptide as well as insertions of one or more amino acids to other improved transaminase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Fragment" as used herein refers to a polypeptide that has an amino-terminal and/or carboxy-terminal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%. 95%, 98%, and 99% of a full-length transaminase polypeptide.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The improved transaminase enzymes may be present within a cell, present in the cellular medium, or prepared in various forms, such as lysates or isolated preparations. As such, in some embodiments, the improved transaminase enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure transaminase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated improved transaminases polypeptide is a substantially pure polypeptide composition.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Where a mixture contains more than two diastereomers it is common to report the ratio of diastereomers or "diastereomeric ratio" rather than diastereomeric excess. Enantiomeric excess and diastereomeric excess are types of stereomeric excess. "Highly stereoselective" refers to a transaminase polypeptide that is capable of converting the substrate to the corresponding chiral amine product with at least about 85% stereomeric excess.

"Improved enzyme property" refers to a transaminase polypeptide that exhibits an improvement in any enzyme property as compared to a reference transaminase, such as the wild-type transaminase enzyme or another improved engineered transaminase. Enzyme properties for which improvement is desirable include, but are not limited to, enzymatic activity (which can be expressed in terms of percent conversion of the substrate), thermo stability, solvent stability, pH activity profile, cofactor requirements, refractoriness to inhibitors (e.g., substrate or product inhibition), stereospecificity, and stereoselectivity (including enantioselectivity).

"Increased enzymatic activity" refers to an improved property of the engineered transaminase polypeptides, which can be represented by an increase in specific activity (e.g., product produced/time/weight protein) or an increase in percent conversion of the substrate to the product (e.g., percent conversion of starting amount of substrate to product in a specified time period using a specified amount of transaminase) as compared to the reference transaminase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type transaminase enzyme, to as much as 2 fold, 5 fold, 10 fold, 20 fold. 25 fold, 50 fold, 75 fold, 100 fold, or more enzymatic activity than the naturally occurring transaminase or another engineered transaminase from which the transaminase polypeptides were derived. In specific embodiments, the engineered transaminase enzyme exhibits improved enzymatic activity in the range of 1.5 to 50 fold, 1.5 to 100 fold or greater than that of the parent transaminase enzyme. Transaminase activity can be measured by any one of standard assays, such as by monitoring changes in spectrophotometric properties of reactants or products. In some embodiments, the amount of products produced can be measured by High-Performance Liquid Chromatography (HPLC) separation combined with UV absorbance or fluorescent detection following o-phthaldialdehyde (OPA) derivatization. Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

"Conversion" refers to the enzymatic conversion of the substrate(s) to the corresponding product(s). "Percent conversion" refers to the percent of the substrate that is converted to the product within a period of time under specified conditions. Thus, the "enzymatic activity" or "activity" of a transaminase polypeptide can be expressed as "percent conversion" of the substrate to the product.

"Thermostable" refers to a transaminase polypeptide that maintains similar activity (more than 60% to 80% for example) after exposure to elevated temperatures (e.g., 40-80° C.) for a period of time (e.g., 0.5-24 hrs) compared to the wild-type enzyme.

"Solvent stable" refers to a transaminase polypeptide that maintains similar activity (more than e.g., 60% to 80%) after exposure to varying concentrations (e.g., 5-99%) of solvent (ethanol, isopropyl alcohol, dimethylsulfoxide (DMSO), tetrahydrofuran, 2-methyltetrahydrofuran, acetone, toluene, butyl acetate, methyl tert-butyl ether, etc.) for a period of time (e.g., 0.5-24 hrs) compared to the wild-type enzyme.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5*SSPE, 0.2% SDS at 42° C., followed by washing in 0.2×SSPE, 0.2% SDS, at 42° C. "High stringency hybridization" refers generally to conditions that are about 10° C. or less from the thermal melting temperature T as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C. it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the transaminases enzymes may be codon optimized for optimal production from the host organism selected for expression.

"Control sequence" refers herein to include all components, which are necessary or advantageous for the expression of a polynucleotide and/or polypeptide of the present disclosure. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Alkyl" refers to groups of from 1 to 18 carbon atoms, either straight chained or branched, particularly from 1 to 8 carbon atoms, and more particularly 1 to 6 carbon atoms. An alkyl with a specified number of carbon atoms is denoted in parenthesis, e.g., (C1-C4)alkyl refers to an alkyl of 1 to 4 carbon atoms.

"Alkenyl" refers to groups of from 2 to 12 carbon atoms, either straight or branched containing at least one double bond but optionally containing more than one double bond.

"Alkynyl" refers to groups of from 2 to 12 carbon atoms, either straight or branched containing at least one triple bond but optionally containing more than one triple bond, and optionally containing one or more double bonded moieties.

"Aryl" refers to an unsaturated aromatic carbocyclic group of from 5 to 14 carbon atoms having a single ring (e.g., phenyl) or multiple condensed rings (e.g., naphthyl or anthryl). For multiple condensed rings, at least one of the rings is aromatic. Representative aryls include phenyl, pyridyl, naphthyl and the like.

"Arylalkyl" refers to an alkyl substituted with an aryl moiety. Representative arylalkyl groups include benzyl, phenethyl and the like.

"Arylalkenyl" refers to an alkenyl as defined herein substituted with an aryl group.

"Arylalkynyl" refers to an alkynyl as defined herein substituted with an aryl group.

"Heteroaryl" refers to an aromatic heterocyclic group of 5 to 14 ring atoms containing 1 to 4 ring heteroatoms selected from oxygen, nitrogen and sulfur within the ring. Heteroaryl groups can have a single ring (e.g., pyridyl or furyl) or multiple condensed rings (e.g., indolizinyl or benzothienyl). For multiple condensed rings, at least one of the rings is aromatic.

"Heteroarylalkyl" refers to an alkyl substituted with a heteroaryl moiety as defined herein.

"Heteroarylalkenyl" refers to an alkenyl substituted with a heteroaryl group as defined herein.

"Heteroarylalkynyl" refers to an alkynyl substituted with a heteroaryl moiety as defined herein.

"Cycloalkyl" refers to cyclic alkyl groups of from 3 to 12 carbon atoms having a single cyclic ring or multiple condensed rings. Representative cycloalkyl groups include, by way of example, single ring structures such as cyclopropyl, cyclobutyl, cyclopentyl, cyclooctyl, 1-methylcyclopropyl, 2-methylcyclopentyl, 2-methylcyclooctyl, and the like, or multiple ring structures, including bridged ring systems, such as adamantyl, and the like.

"Heterocycle" and interchangeably "heterocycloalkyl" refer to a saturated or unsaturated group having a single ring or multiple condensed rings, from 3 to 14 ring atoms having from 1 to 4 hetero atoms selected from nitrogen, sulfur or oxygen within the ring. Heterocyclic groups can have a single ring (e.g., piperidinyl or tetrahydrofuryl) or multiple condensed rings (e.g., indolinyl, dihydrobenzofuran or quinuclidinyl). Representative heterocycles and heteroaryls include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

"Cycloalkylalkyl" refers to an alkyl substituted with a cycloalkyl moiety as defined herein.

"Cycloalkylalkenyl" refers to an alkenyl substituted with a cycloalkyl moiety as defined herein.

"Cycloalkylalkynyl" refers to an alkynyl substituted with a cycloalkyl moiety as defined herein.

"Heterocycloalkylalkyl" refers to an alkyl substituted with a heterocycloalkyl moiety as defined herein.

"Heterocycloalkenyl" refers to an alkenyl substituted with a heterocycloalkyl moiety as defined herein.

"Heterocycloalkylalkynyl" refers to an alkynyl substituted with a heterocycloalkyl moiety as defined herein.

"Alkoxy" or "Alkyloxy" refers to the group alkyl-O— wherein the alkyl group is as defined above, including optionally substituted alkyl groups as also defined above.

"Amino" refers to the group —NH$_2$. Substituted amino refers to the group —NHR', NR'R', and NR'R'R', where each R' is independently of the others selected from substituted or unsubstituted alkyl, cycloalkyl, heterocycloalkyl, cycloalkylalkyl, heterocycloalkylalkyl, alkyloxy, aryl, heteroaryl, arylalkyl, heteroarylalkyl, acyl, alkyloxycarbonyl, sulfanyl, sulfinyl, sulfonyl, and the like. Typical amino groups include, but are limited to, dimethylamino, diethylamino, trimethylammonium, triethylammonium, methylsulfonylamino, furanyl-oxy-sulfamino, and the like.

"Carboxy" refers to —COOH.

"Carbonyl" refers to —C(O)—, which may have a variety of substituents to form different carbonyl groups including acids, acid halides, aldehydes, amides, esters, and ketones.

"Hydroxy" refers to —OH.

"Cyano" refers to —CN.

"Halogen" or "halo" refers to fluoro, chloro, bromo and iodo.

"Sulfonyl" refers to —SO$_2$—. Substituted sulfonyl refers to —SO$_2$R', where R' is a suitable substituent as described below.

"Fused" or "fused rings" such as in fused aryl or fused heteroaryl refers to two or more rings joined such that they have at least two ring atoms in common. Fused aryl refers to fused rings in which at least one of the rings is an aryl. Fused heteroaryl refers to fused rings in which at least one of the rings is a heteroaryl.

"Substituted" unless otherwise specified, refers to replacement of positions occupied by hydrogen in the foregoing groups with substituents exemplified by, but not limited to, hydroxy, oxo, nitro, methoxy, ethoxy, alkyloxy, substituted alkyloxy, trifluoromethoxy, haloalkyloxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkyloxyalkyl, thio, alkylthio, acyl, carboxy, alkyloxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

"Optional" or "optionally" means that the subsequently described event or circumstance may or may not occur, and that the description includes instances where said event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

"Protecting group" refers to a group of atoms that mask, reduce or prevent the reactivity of the functional group when attached to a reactive functional group in a molecule. Typically, a protecting group may be selectively removed as desired during the course of a synthesis. Examples of protecting groups can be found in Wuts and Greene, "Greene's Protective Groups in Organic Synthesis." 4$^{th}$ Ed., Wiley Interscience (2006), and Harrison et al., Compendium of Synthetic Organic Methods, Vols. 1-8, 1971-1996, John Wiley & Sons, NY. Functional groups that can have a protecting group include, but are not limited to, hydroxy, amino, and carboxy groups. Representative amino protecting groups include, but are not limited to, formyl, acetyl, trifluoroacetyl, benzyl, benzyloxycarbonyl ("CBZ"), tert-butoxycarbonyl ("Boc"), trimethylsilyl ("TMS"), 2-trimethylsilyl-ethanesulfonyl ("SES"), trityl and substituted trityl groups, allyloxycarbonyl, 9-fluorenylmethyloxycarbonyl ("FMOC"), nitro-veratryloxycarbonyl ("NVOC") and the like. Representative hydroxyl protecting groups include, but are not limited to, those where the hydroxyl group is either acylated (e.g., methyl and ethyl esters, acetate or propionate groups or glycol esters) or alkylated such as benzyl and trityl ethers, as well as alkyl ethers, tetrahydropyranyl ethers, trialkylsilyl ethers (e.g., TMS or TIPPS groups) and allyl ethers. Other protecting groups can be found in the references noted herein.

"Leaving group" generally refers to any atom or moiety that is capable of being displaced by another atom or moiety in a chemical reaction. More specifically, a leaving group refers to an atom or moiety that is readily displaced and substituted by a nucleophile (e.g., an amine, a thiol, an alcohol, or cyanide). Such leaving groups are well known and include carboxylates, N-hydroxysuccinimide ("NHS"), N-hydroxybenzotriazole, a halogen (fluorine, chlorine, bromine, or iodine), and alkyloxy groups. Non-limiting characteristics and examples of leaving groups can be found, for example in Organic Chemistry, 2d ed., Francis Carey (1992), pages 328-331; Introduction to Organic Chemistry, 2d ed., Andrew Streitwieser and Clayton Heathcock (1981), pages 169-171; and Organic Chemistry, 5th Ed., John McMurry, Brooks/Cole Publishing (2000), pages 398 and 408; all of which are incorporated herein by reference.

"Suitable reaction conditions" refers to those conditions in the biocatalytic reaction solution (e.g., ranges of enzyme loading, substrate loading, cofactor loading, temperature, pH, buffers, co-solvents, etc.) under which a transaminase polypeptide of the present disclosure capable of converting a substrate to the desired amino product compound, e.g., converting compound (2) to compound (1). Exemplary "suitable reaction conditions" are provided in the present disclosure and illustrated by the Examples.

"Loading", such as in "compound loading" or "enzyme loading" refers to the concentration or amount of a component in a reaction mixture at the start of the reaction.

"Substrate" in the context of a biocatalyst mediated process refers to the compound or molecule acted on by the biocatalyst. For example, an exemplary substrate for the transaminase biocatalyst in the processes disclosed herein is compound (2), whose preparation is described in U.S. Pat. No. 7,326,708 B2, issued Feb. 5, 2008.

"Product" in the context of a biocatalyst mediated process refers to the compound or molecule resulting from the action of the biocatalyst. For example, an exemplary product for the transaminase biocatalyst in the processes disclosed herein is compound (1).

5.3 ENGINEERED POLYPEPTIDES HAVING TRANSAMINASE ACTIVITY

The present disclosure provides engineered polypeptides having transaminase activity (also referred to herein as "engineered transaminase polypeptides") useful for the selective transamination of amino acceptor substrate compounds of structural Formula (II) (see Scheme 3) to produce chiral amine products of structural Formula (I), which, in some embodiments, can include compound (1), the active pharmaceutical ingredient, sitagliptin. Accordingly, in one aspect, the present disclosure relates to engineered polypeptides having transaminase activity which are capable of converting substrate compound (2) to product compound (1) as shown in Scheme 2. Further, the present disclosure provides polynucleotides encoding the engineered polypeptides, associated vectors and host cells comprising the polynucleotides, methods for making the engineered polypeptides, and methods for using the engineered polypeptides, including suitable reaction conditions.

The engineered polypeptides of the disclosure are non-naturally occurring transaminases engineered to have improved enzyme properties (such as increased stereoselectivity) as compared to the wild-type transaminase polypeptide of *Arthrobacter* sp. KNK168 (GenBank Acc. No. BAK39753.1, GI: 336088341), and also as compared to the reference engineered transaminase polypeptide of SEQ ID NO:2, which was used as the starting backbone sequence for the directed evolution of the engineered polypeptides of the present disclosure. The reference engineered transaminase polypeptide of SEQ ID NO:2 has the following 28 amino acid differences relative to the wild-type transaminase of *Arthrobacter* sp. KNK168; S8P, Y60F, L61Y, H62T, V65A, V69T, D81G, M94I, I96L, F122M, S124T, S126T, G136F, Y150S, V152C, A169L, V199I, A209L, G215C, G217N, S223P, L269P, L273Y, T282S, A284G, P297S, I306V, and S321P.

The engineered transaminase polypeptides of the present disclosure were generated by directed evolution of SEQ ID NO:2 for efficient conversion of compound (2) to compound (1) under certain industrially relevant conditions and have one or more residue differences as compared to the reference engineered transaminase polypeptide of SEQ ID NO:2. These residue differences are associated with improvements in various enzyme properties, particularly increased activity, increased stereoselectivity, increased stability, and tolerance of increased substrate and/or product concentration (e.g., decreased product inhibition). Accordingly, in some embodiments, the engineered polypeptides having transaminase activity are capable of converting the substrate compound (2) to compound (1) with an activity that is increased at least about 1.2 fold, 1.5 fold, 2 fold, 3 fold, 4 fold, 5 fold, 10 fold, 20 fold, 30 fold. 40 fold, 50 fold, 100 fold, 200 fold, 500 fold, 1000 fold or more relative to the activity of the reference polypeptide of SEQ ID NO:2 under suitable reaction conditions. In some embodiments, the engineered polypeptides having transaminase activity are capable of converting the substrate of compound (2) to compound (1) with a percent conversion of at least about 40%/0, at least about 50%, at least about 60%, at least about 70%, at least about 80%, or at least about 90%, at least about 95%, at least about 98%, at least about 99%, in a reaction time of about 48 h, about 36 h, about 24 h, or even a shorter length of time, under suitable reaction conditions. In some embodiments, the engineered polypeptides having transaminase activity are capable of converting compound (2) to compound (1) in enantiomeric excess of at least 90%, 95%, 97%. 98%, 99%, or greater, under suitable reaction conditions.

The present disclosure provides numerous exemplary engineered transaminase polypeptides comprising amino acid sequences of the even-numbered sequence identifiers SEQ ID NO:4-306. These exemplary engineered transaminase polypeptides comprise amino acid sequences that include one or more of the following residue differences associated with their improved properties for conversion of compound (2) to compound (1) as compared to SEQ ID NO:2: (a) X33L. X36C, X41C/F/K/M/N/R, X42G, X48D/E/G/K/T, X51K, X54P, X76S, X122F/Q, X148Q, X155A/I/K/T/V, X156R, X160P, X215G/H/L, X241R, X270T, X273H, X325M; and X241R; and/or (b) a combination of residue differences as compared to SEQ ID NO:2 selected from; X42G, X54P, X152S, and X155T; X42G, X54P, X152S, X155T, and R164P; X42G, X54P, X150F, X152S, and X155T; X42G, X54P, X150F, X152S, X155T, and X267V; X42G, X54P, X150F, X152S, X155L, W156Q, and C215G; X42G, X54P, X150F, X152S, X155T, X215G, and X267V; X33L; X42G, X54P, X117G; X150F, X152S, X155I, X156Q, and C215G; and X41K, X42G, X54P, X150F, X152S, X155K, X156Q, and C215G; X33L, X42G, X54P, X109S, X150F, X152S, X155K, X156Q, and X215H; X33L, X42G, X54P, X150F, X152S, X155I, X156Q, and X215G; X33L, X42G, X54P, X150F, X152S, X155K, X156Q, and X215H; X33L, X42G, X54P, X150F, X152S, X155L, X156Q, and X215H; X33L, X42G, X54P, X150F, X152S, X155L, X156Q, X215H, and X241R; X41F, X42G, X54P, X122Q, X150F, X152T, X155V, X156Q, and X215G; X41F, X42G, X54P, X150F, X152S, X155L, X156Q, X171I, X215G, and X241R; X41F, X42G, X54P, X150F, X152S, X155I, X156Q, V171I, and X215G; X41F, X42G, X54P, X150F, X152S, X155I, X156Q, and X215G; X41F, X42G, X54P, X150F, X152S, X155L, X156Q, X171I, and X215G; X41F, X42G, X54P, X150F, X152S, X155L, X156Q, and X215G; X42G, X48G, X54P, X150F, X152S, X155L, X156Q, and X215H; X42G, X54P, X60V, X150F, X152S, X155L, X156Q, and X215G; X42G, X54P, X68A, X150F, X152S, X155L, X156Q, and X215G; X42G, X54P, X69S, X150F, X152S, X155L, X156Q, and X215G; X42G, X54P, X122Q, X150F, X152S, X155I, X156Q, X215G, and X241R; X42G, X54P, X122Q, X150F, X152S, X155L, X156Q, X171I, X215G, and X241R; X42G, X54P, X122Q, X150F, X152T, X155V, X156Q, X171I, X215G, and X241R; X42G, X54P, X126M, X150F, X152S, X155L, X156Q, and X215G; X42G, X54P, X135I, X136Y, X150F, X152S, X155L, X156Q, X192F, and X215G; X42G, X54P, X136I, X150F, X152S, X155L, X156Q, and X215G; X42G, X54P, X136I, X150F, X152S, X155L, X156Q, X215G, and X224I; X42G, X54P, X136I, X150F, X152S, X155L, X156Y, X215G, X282V, and X284I; X42G, X54P, X136I, X150F, X152S, X155L, X156Y, X215G, and X284P; X42G, X54P, X136Y, X150F, X152S, X155L, X156Q, X215G, X282V, and X284P; X42G, X54P, X150F, X152S, X155I, X156Q, X171I, X215G, and X241R; X42G, X54P, X150F, X152S, X155L, X156Q, X193M, and X215G; X42G, X54P, X150F, X152S, X155L, X156Q, X215G, X282V, and X284I; X42G, X54P, X150F, X152S, X155L, X156Q, X215G, and X283S; X42G, X54P, X150F, X152S, X155L, X156Q, X215G, and X284I; and X42G, X54P, X150F, X152S, X155L, X156Y, and X215G.

In some cases, the exemplary engineered polypeptides have an amino acid sequence that further comprises one or more residue differences as compared to SEQ ID NO:2 selected from: X5K, X33L, X36C, X41C/F/K/M/N/R, X42A/G, X44Q, X48D/E/G/K/T, X49T, X51K, X54P, X55L, X76S, X108V, X117G, X122F/Q, X126A, X148Q, X150A/F, X152S/T, X155A/I/K/L/T/V, X156Q/R/S, X160P, X164P, X165N, X182T, X215G/H/L, X218M, X241R, X267V, X270T, X273H, X325M, and X328I. C215G. In some cases, the exemplary engineered polypeptides have an amino acid sequence that further comprises one or more residue differences as compared to SEQ ID NO:2 selected from: G36C, I41C, I41F, I41K, I41M, I41N, I41R, E42G, P48D, P48E, P48G, P48K, P48T, A51K, S54P, M122F, M122Q, Y148Q, C152T, Q155A, Q155I, Q155K, Q155T, Q155V, C215H, C215L, Y273H, L325M, and A241R; or (b) a combination of residue differences selected from; A5K, E42G, S49T, S54P, C152S, Q155T, and W156Q; P33L, I41C, E42G, S54P, S150F, C152S, Q155K, F160P, and C215G; P33L, I41K, E42G, S54P, S150F, C152S, Q155I, F160P, and C215L; P33L, E42G, P48G, S54P, S150F, C152S, Q155T, and C215H; P33L, E42G, S54P, A109S, S150F, C152S, Q155K, W156Q, and C215H; P33L, E42G, S54P, E117G, S150F, C152S, Q155I, W156Q, and C215G; P33L, E42G, S54P, S150F, C152S, Q155I, W156Q, and C215G; P33L, E42G, S54P, S150F, C152S, Q155K, W156Q, and C215H; P33L, E42G, S54P, S150F, C152S, Q155L, W156Q, and C215H; P33L, E42G, S54P, S150F, C152S, Q155L, W156Q, C215H, and A241R; G36C, E42G, P48G, S54P, S150F, C152S, Q155I, and C215H; G36C, E42G, P48K, S54P, S150F, C152S, Q155T, and C215H; G36C, E42G, S54P, S150F, C152S, Q155I, C215H, and A241R; G36C, E42G, S54P, S150F, C152S, Q155K, C215H, and A241R; G36C, E42G, S54P, S150F, C152S, Q155T, and A241R; G36C, E42G, S54P, S150F, C152S, Q155V, and C215H; I41C, E42G, S49T, S54P, S150F, C152S, Q155I, F160P, C215G, and I267V; I41C, E42G, S49T, S54P, S150F, C152S, Q155K, W156Q, C215G and I267V; I41C, E42G, S54P, I108V, S150F, C152S, and Q155K; I41C, E42G, S54P, I108V, S150F, C152S, Q155K, W156Q, C215G, and I267V; I41C, E42G, S54P, I108V, S150F, C152S, Q155T, W156Q, and C215G; I41C, E42G, S54P, E117G, S50F, C152S, Q155K, and F160P; I41C, E42G, S54P, E117G, S150F, C152S, Q155K, and C215L; I41C, E42G, S54P, E117G, S150F, C152S, Q155L, and C215L; I41C, E42G, S54P, S150F, C152S, Q155I, and C215G; I41C, E42G, S54P, S150F, C152S, Q155I, and C215L; I41C, E42G, S54P, S150F, C152S, Q155K, W156Q, C215G, and I267V; I41C, E42G, S54P, S150F, C152S, Q155K, and C215L; I41C, E42G, S54P, S150F, C152S, Q155K, and C215G; I41C, E42G, S54P, S150F, C152S, Q155L, F160P, C215G, and I267V; I41C, E42G, S54P, S150F, C152S, Q155L, F160P, C215G, and I267V; I41C, E42G, S54P, S150, C152S, Q155T, W156Q, F160P, and C215L; I41C, E42G, S54P, S150F, C152S, Q155T, W156Q, and C215L; I41F, E42G, S54P, M122Q, S150F, C152T, Q155V, W156Q, and C215G; I41F, E42G, S54P, S150F, C152S, Q155L, W156Q, V171I, and C215G; I41F, E42G, S54P, S150F, C152S, Q155L, W156Q, V171I, C215G, and A241R; I41F, E42G, S54P, S150F, C152S, Q155I, W156Q, and C215G; I41K, E42G, P48E, S54P, S150, C152S, Q155K, and W156Q; I41K, E42G, P48E, S54P, S150F, C152S, Q155L, and C215L; I41K, E42G, S54P, I108V, E117G, S150F, C152S, Q155K, and C215L; I41K, E42G, S54P, I108V, S150F, C152S, Q155T, and C215G; I41K, E42G, S54P, E117G, S150, C152S, Q155L, and C215G; I41K, E42G, S54P, E117G, S150F, C152S, Q155K, C215L, and I267V; I41K, E42G, S54P, S150F, C152S, Q155K, W156Q, and C215G; I41K, E42G, S54P, S150F, C152S, Q155K, F160P, C215G, and I267V; I41K, E42G, S54P, S150F, C152S, Q155K, and C215L; I41K, E42G, S54P, S150F, C152S, and Q155T; I41K, E42G, S54P, S150F, C152S, Q155T, and F160P; I41K, E42G, S54P, S150F, C152S, Q155T, and C215G; I41K, E42G, S54P, S150F, C152S, Q155T, C215G, and I267V; I41K, E42G, S54P, S150F, C152S, Q155K, W156Q, and C215G; I41N, E42G, S54P, S150F, C152S, Q155I, and F160P; I41N, E42G, S54P, E117G, S150F, C152S, Q155T; and W156Q; I41N, S49T, E42G, S54P, S150F, C152S, Q155L, F160P, D165N, and C215L; E42A, A44Q, S54P, I108V, S150F, C152S, Q155T, and I267V; E42G, A44Q, S54P, I108V, S150, C152S, and Q155T; E42G, A44Q, S54P, I108V, S150F, C152S, Q155T, and I267V; E42G, A44Q, S54P, S150A, C152S, and Q155T; E42G, A44Q, S54P, S150F, C152S, and Q155T; E42G, P48G, S54P, S150F, C152S, Q155L, W156Q, and C215H; E42G, P48G, S54P, S150, C152S, and Q155T; E42G, S49T, S54P, I108V, E117G, S150, C152S, Q155L, F160P, and C215L; E42G, S49T, S54P, I108V, E117G, S150F, C152S, Q155K, W156Q, and C215G; E42G, S49T, S54P, I108V, E117G, S150F, C152S, Q155T, W156Q, C215G, and I267V; E42G, S49T, S54P, C152S, Q155T, and W156Q; E42G, S54P, I55L, T126A, C152S, Q155T, L218M, and A270T; E42G, S54P, F60V, S150F, C152S, Q155L, W156Q, and C215G; E42G, S54P, T68A, S150F, C152S, Q115L, W156Q, and C215G; E42G, S54P, T69S, S150F, C152S, Q155L, W156Q, and C215G; E42G, S54P, N76S, T126A, C152S, Q155T, S182T, L218M, A270T, and V328I; E42G, S54P, I108V, S150F, C152S, Q155K, and C215H; E42G, S54P, I108V, S150, C152S, and Q155T; E42G, S54P, I108V, S150, C152S, Q155T, and I267V; E42G, S54P, I108V, S150F, C152S, Q155V, W156Q, and F160P; E42G, S54P, E117G, C152S, and Q155T; E42G, S54P, E117G, C152S, Q155T, and W156Q; E42G, S54P, M122Q, S150F, C152S, Q155I, W156Q, C215G, and A241R; E42G, S54P, M122Q, S150F, C152S, Q155L, W156Q, V171I, C215G, and A241R E42G, S54P, M122Q, S150F, C152T, Q155V, W156Q, V171I, C215G, and A241R; E42G, S54P, T126M, S150F, C152S, Q155L, W156Q, and C215G; E42G, S54P, P135I, F136Y, S150F, C152S, Q155L, W156Q, W192F, and C215G; E42G, S54P, F136I, S150F, C152S, Q155L, W156Q, and C215G; E42G, S54P, F136I, S150F, C152S, Q155L, W156Q, C215G, and G224I; E42G, S54P, F136I, S150F, C152S, Q155L, W156Y, C215G, S282V, and G284I; E42G, S54P, F136I, S150F, C152S, Q155L, W156Y, C215G, and G284P; E42G, S54P, F136Y, S150F, C152S, Q155L, W156Q, C215G, S282V, and G284P; E42G, S54P, S150A, C152S, Q155T, and I267V; E42G, S54P, S150F, C152S, Q155I, W156Q, F160P, C215L, and I267V; E42G, S54P, S150F, C152S, Q155I, W156Q, V171I, C215G, and A241R; E42G, S54P, S150F, C152S, Q155I, W156Q, and C215L; E42G, S54P, S150F, C152S, Q155I, F160P, and C215G; E42G, S54P, S150F, C152S, Q155I, and C215H;

E42G, S54P, S150F, C152S, Q155K, and W156Q; E42G, S54P, S150F, C152S, Q155K, W156Q, and I267V; E42G, S54P, S150F, C152S, Q155L, W156Q, G193M, and C215G; E42G, S54P, S150F, C152S, Q155L, W156Q, and C215G; E42G, S54P, S150F, C152S, Q155L, W156Q, C215G, S282V, and G284I; E42G, S54P, S150F, C152S, Q155L, W156Q, C215G, and T283S; E42G, S54P, S150F, C152S, Q155L, W156Q, C215G, and G284I; E42G, S54P, S150F, C152S, Q155L, W156Y, and C215G; E42G, S54P, S150F, C152S, Q155L, and C215H; E42G, S54P, S150F, C152S, and Q155T; E42G, S54P, S150F, C152S, Q155T, C215G, and I267V; E42G, S54P, S150F, C152S, Q155T, and I267V; E42G, S54P, S150F, C152S, Q155T, W156Q, F160P, C215L, and I267V; E42G, S54P, S150F, C152S, Q155T, W156Q, C215G, and I267V; E42G, S54P, S150F, C152S, Q155T, and W156R; E42G, S54P, S150F, C152S, Q155T, F160P, and C215G; E42G, S54P, S150F, C152S, Q155T, F160P, and C215L; E42G, S54P, S150F, C152S, Q155T, C215G, and I267V; E42G, S54P, S150F, C152S, Q155T, and I267V; E42G, S54P, C152S, Q155I, and W156S; E42G, S54P, C152S, Q155K, and W156S; E42G, S54P, C152S, Q155L, and W156S; E42G, S54P, C152S, and Q155T; E42G, S54P, C152S, Q155T, and F160P; E42G, S54P, C152S, Q155T, and R164P; E42G, S54P, C152S, Q155T, and W156Q; E42G, S54P, C152S, Q155T, and W156S; E42G, S54P, C152S, Q155T, and R164P; E42G, S54P, C152S, Q155T, S182T, L218M, and A270T; E42G, S54P, C152S, Q155T, and C215G; E42G, S54P, C152S, Q155T, and C215L; and E42G, S54P, C152S, Q155V, and W156S.

In some embodiments, the engineered polypeptides having transaminase activity are capable of converting compound (2) to compound (1) with increased tolerance for the presence of the substrate relative to the substrate tolerance of the reference polypeptide of SEQ ID NO:2 under suitable reaction conditions. Accordingly, in some embodiments the engineered polypeptides are capable of converting the substrate of compound (2) to compound (1) in the presence of a substrate loading concentration of at least about 1 g/L, 5 g/L, 10 g/L, 20 g/L, about 30 g/L, about 40 g/L, about 50 g/L, about 70 g/L, about 100 g/L, with a percent conversion of at least about 40%, at least about 50%, at least about 60%, at least about 70%, at least about 80%, at least about 90%, at least about 95%, at least about 98%, or at least about 99%, in a reaction time of about 72 h, about 48 h, about 36 h, about 24 h, or even shorter length of time, under suitable reaction conditions.

The suitable reaction conditions under which the above-described improved properties of the engineered polypeptides can be determined with respect concentrations or amounts of polypeptide, substrate, amine donor, cofactor, buffer, co-solvent, pH, and/or conditions including temperature and reaction time. In some embodiments, the suitable reaction conditions comprise the HTP, SFP, or DSP assay conditions described below and in the Examples.

Structure and function information for exemplary non-naturally occurring, engineered transaminase polypeptides of the present disclosure are shown below in Tables 2A, 2B, and 2C. The odd numbered sequence identifiers (i.e., SEQ ID NO) refer to the nucleotide (nt) sequence encoding the amino acid (aa) sequence provided by the even numbered SEQ ID NOs, and the sequences are provided in the electronic sequence listing file accompanying this disclosure, which are hereby incorporated by reference herein. The amino acid residue differences are based on comparison to the reference polypeptide sequence of SEQ ID NO:2, the gene sequence of which was used as the starting point for the directed evolution of engineered polypeptides having increased activity in converting compound (2) to compound (1) under certain industrially useful reaction conditions. The activity of each engineered polypeptide was determined using a high-throughput (HTP) assay (as a primary screen), and, in some cases, a secondary shake-flask powder (SFP) and/or downstream processed (DSP) powder assay. The HTP assay values provided in Table 2A were determined using *E. coli* clear cell lysates in 96 well-plate format following assay reaction conditions as noted in the Table. The SFP and DSP enzyme preparations provide a more purified powder preparation of the engineered polypeptides. The SFP assay values in Table 2B were determined using SFP of the engineered polypeptides in a 5 mL vial format using reaction conditions noted in the Table. The DSP assay values in Table 2C were determined using DSP powders of the engineered polypeptides in a 5 mL vial format using reaction conditions noted in the Table. Further details of the HTP, SFP, and DSP preparations and assays are described in the Examples.

TABLE 2A

HTP Activity

| SEQ ID NO: (nt/aa) | Amino Acid Differences (compared to SEQ ID NO: 2) | Activity Fold-Improvement[1] | Assay Reaction Conditions[2] |
|---|---|---|---|
| 1/2 | None | 1 | A |
| 3/4 | A241R | 1.5 | A |
| 5/6 | A241R; L325M | 1.4 | A |
| 7/8 | G36C | 1.4 | A |
| 9/10 | P48D | 1.5 | A |
| 11/12 | P48T | 1.2 | A |
| 13/14 | I41R | 1.5 | A |
| 15/16 | I41K; L325M | 1.9 | A |
| 17/18 | E42G | 1.3 | A |
| 19/20 | A51K | 2.7 | A |
| 21/22 | P48G | 1.3 | A |
| 23/24 | P48E | 1.6 | A |
| 25/26 | I41F | 1.5 | A |
| 27/28 | I41R; L325M | 1.6 | A |
| 29/30 | P48K | 1.5 | A |
| 31/32 | S54P | 1.4 | A |
| 33/34 | I41M | 1.3 | A |
| 35/36 | I41N | 1.6 | A |
| 37/38 | I41C | 1.9 | A |
| 39/40 | M122Q | 2.3 | A |

TABLE 2A-continued

HTP Activity

| SEQ ID NO: (nt/aa) | Amino Acid Differences (compared to SEQ ID NO: 2) | Activity Fold-Improvement[1] | Assay Reaction Conditions[2] |
|---|---|---|---|
| 41/42 | M122F | 1.7 | A |
| 43/44 | Q155I | 1.3 | A |
| 45/46 | Y148Q | 1.4 | A |
| 47/48 | Q155V | 1.7 | A |
| 49/50 | Q155K | 1.7 | A |
| 51/52 | Q155T | 2.0 | A |
| 53/54 | Q155A | 1.6 | A |
| 55/56 | C152T | 1.6 | A |
| 57/58 | C215L; Y273H | 1.2 | A |
| 59/60 | C215H | 1.4 | A |
| 61/62 | E42G; S54P; C152S; Q155T | 4.0 | A |
| 63/64 | E42G; S54P; C152S; Q155T; R164P | 5.6 | A |
| 65/66 | E42G; S54P; I108V; S150F; C152S; Q155T | 5.6 | B |
| 67/68 | E42G; A44Q; S54P; I108V; S150F; C152S; Q155T | 6.4 | B |
| 69/70 | E42G; S54P; S150F; C152S; Q155T; I267V | 7.6 | B |
| 71/72 | E42G; S54P; I108V; S150F; C152S; Q155T; I267V | 4.4 | B |
| 73/74 | E42G; A44Q; S54P; I108V; S150F; C152S; Q155T; I267V | 6.0 | B |
| 75/76 | E42G; A44Q; S54P; S150F; C152S; Q155T | 6.8 | B |
| 77/78 | E42G; S54P; S150F; C152S; Q155T | 7.6 | B |
| 79/80 | E42A; A44Q; S54P; I108V; S150F; C152S; Q155T; I267V | 6.4 | B |
| 81/82 | E42G; S54P; S150A; C152S; Q155T; I267V | 2.4 | B |
| 83/84 | E42G; A44Q; S54P; S150A; C152S; Q155T | 3.6 | B |
| 85/86 | E42G; S54P; N76S; T126A; C152S; Q155T; S182T; L218M A270T; V328I | 5.2 | B |
| 87/88 | E42G; S54P; I55L; T126A; C152S; Q155T; L218M; A270T | 6.0 | B |
| 89/90 | E42G; S54P; C152S; Q155T; S182T; L218M; A270T | 3.2 | B |
| 91/92 | A5K; E42G; S49T; S54P; C152S; Q155T; W156Q | 4.8 | B |
| 93/94 | E42G; E117G; C152S; Q155T; W156Q | 5.6 | B |
| 95/96 | E42G; S54P; C152S; Q155T; W156Q | 7.6 | B |
| 97/98 | E42G; S54P; E117G; C152S; Q155T | 4.8 | B |
| 99/100 | E42G; S49T; S54P; C152S; Q155T; W156Q | 6.8 | B |
| 101/102 | E42G; S54P; C152S; Q155T; W156S | 9.2 | B |
| 103/104 | E42G; S54P; C152S; Q155T; C215L | 6.0 | B |
| 105/106 | E42G; S54P; C152S; Q155T; C215G | 6.4 | B |
| 107/108 | E42G; S54P; C152S; Q155I; W156S | 13.2 | B |
| 109/110 | E42G; S54P; C152S; Q155V; W156S | 9.6 | B |
| 111/112 | E42G; S54P; C152S; Q155L; W156S | 14.8 | B |
| 113/114 | E42G; S54P; C152S; Q155K; W156S | 13.6 | B |
| 115/116 | E42G; S54P; C152S; Q155T; F160P | 6.8 | B |
| 117/118 | I41K; E42G; S54P; S150F; C152S; Q155T; C215G | 14.4 | B |
| 119/120 | I41C; E42G; S54P; S150F; C152S; Q155I; C215G | 12.8 | B |
| 121/122 | E42G; S54P; S150F; C152S; Q155T; C215G; I267V | 14.8 | B |
| 123/124 | I41K; E42G; S54P; I108V; S150F; C152S; Q155T; C215G | 12.4 | B |
| 125/126 | I41C; E42G; S54P; I108V; S150F; C152S; Q155K; W156Q; C215G; I267V | 18.4 | B |
| 127/128 | E42G; S49T; S54P; I108V; E117G; S150F; C152S; Q155L; F160P; C215L | 4.0 | B |
| 129/130 | E42G; S54P; S150F; C152S; Q155L; W156Q; C215G | 5.6 | B |
| 131/132 | I41C; E42G; S49T; S54P; S150F; C152S; Q155K; W156Q; C215G; I267V | 6.4 | B |
| 133/134 | I41C; E42G; S54P; S150F; C152S; Q155T; W156Q; C215L | 7.6 | B |
| 135/136 | E42G; S54P; S150F; C152S; Q155K; W156Q; I267V | 4.4 | B |
| 137/138 | I41N; E42G; S54P; S150F; C152S; Q155I; F160P | 6.0 | B |
| 139/140 | I41K; E42G; S54P; S150F; C152S; Q155K; F160P; C215G; I267V | 6.8 | B |
| 141/142 | I41N; S49T; E42G; S54P; S150F; C152S; Q15SL; F160P; D165N; C215L | 7.6 | B |
| 143/144 | I41C; E42G; S54P; S150F; C152S; Q155K; C215G | 6.4 | B |
| 145/146 | I41K; E42G; P48E; S54P; S150F; C152S; Q155K; W156Q | 2.4 | B |
| 147/148 | I41C; E42G; S54P; S150F; C152S; Q155T; W156Q; F160P; C215L | 3.6 | B |
| 149/150 | I41C; E42G; S54P; E117G; S150F; C152S; Q155K; F160P | 5.2 | B |
| 151/152 | E42G; S54P; S150F; C152S; Q155I; W156Q; F160P; C215L; I267V | 6.0 | B |
| 153/154 | I41C; E42G; S54P; S150F; C152S; Q155K; C215L | 3.2 | B |
| 155/156 | E42G; S54P; S150F; C152S; Q155T; W156Q; C215G; I267V | 4.8 | B |
| 157/158 | E42G; S54P; S150F; C152S; Q155T; F160P; C215L | 5.6 | B |
| 159/160 | P33L; E42G; S54P; E117G; S150F; C152S; Q155I; W156Q; C215G | 7.6 | B |
| 161/162 | I41K; E42G; S54P; S150F; C152S; Q155K; C215L | 4,8 | B |
| 163/164 | E42G; S54P; I108V; S150F; C152S; Q155T | 6.8 | B |
| 165/166 | I41C; E42G; S54P; I108V; S150F; C152S; Q155T; W156Q; C215G | 9.2 | B |
| 167/168 | E42G; S54P; S150F; C152S; Q155T; F160P; C215G | 6.0 | B |

TABLE 2A-continued

| SEQ ID NO: (nt/aa) | Amino Acid Differences (compared to SEQ ID NO: 2) | HTP Activity Activity Fold-Improvement[1] | Assay Reaction Conditions[2] |
|---|---|---|---|
| 169/170 | I41C; E42G; S54P; E117G; S150F; C152S; Q155L; C215L | 6.4 | B |
| 171/172 | I41C; E42G; S54P; S150F; C152S; Q155K; W156Q; C215G; I267V | 13.2 | B |
| 173/174 | I41C; E42G; S49T; S54P; S150F; C152S; Q155I; F160P; C215G; I267V | 9.6 | B |
| 175/176 | I41C; E42G; S54P; S150F; C152S; Q155L; F160P; C215G; I267V | 14.8 | B |
| 177/178 | I41K; E42G; S54P; S150F; C152S; Q155K; W156Q; C215G | 13.6 | B |
| 179/180 | I41K; E42G; P48E; S54P; S150F; C152S; Q155L; C215L | 6.8 | B |
| 181/182 | P33L; I41K; E42G; S54P; S150F; C152S; Q155I; F160P; C215L | 14.4 | B |
| 183/184 | I41K; E42G; S54P; E117G; S150F; C152S; Q155L; C215G | 12.8 | B |
| 185/186 | I41N; E42G; S54P; E117G; S150F; C152S; Q155T; W156Q | 14.8 | B |
| 187/188 | E42G; S54P; I108V; S150F; C152S; Q155V; W156Q; F160P | 12.4 | B |
| 189/190 | E42G; S54P; S150F; C152S; Q155T; W156Q; F160P; C215L; I267V | 18.4 | B |
| 191/192 | P33L; I41C; E42G; S54P; S150F; C152S; Q155K; F160P; C215G | 4.0 | B |
| 193/194 | E42G; S54P; S150F; C152S; Q155I; F160P; C215G | 5.6 | B |
| 195/196 | I41C; E42G; S54P; S150F; C152S; Q155I; C215L | 6.4 | B |
| 197/198 | E42G; S49T; S54P; I108V; E117G; S150F; C152S; Q155K; W156Q; C215G | 7.6 | B |
| 199/200 | I41C; E42G; S54P; E117G; S150F; C152S; Q155K; C215L | 4.4 | B |
| 201/202 | E42G; S54P; S150F; C152S; Q155I; W156Q; C215L | 6.0 | B |
| 203/204 | E42G; S54P; S150F; C152S; Q155T; W156R | 6.8 | B |
| 205/206 | I41K; E42G; S54P; I108V; E117G; S150F; C152S; Q155K; C215L | 7.6 | B |
| 207/208 | E42G; S54P; S150F; C152S; Q155K; W156Q | 6.4 | B |
| 209/210 | I41K; E42G; S54P; S150F; C152S; Q155T; F160P | 2.4 | B |
| 211/212 | I41K; E42G; S54P; E117G; S150F; C152S; Q155K; C215L; I267V | 3.6 | B |
| 213/214 | I41K; E42G; S54P; S150F; C152S; Q155T | 5.2 | B |
| 215/216 | I41K; E42G; S54P; S150F; C152S; Q155T; C215G; I267V | 6.0 | B |
| 217/218 | I41C; E42G; S54P; I108V; S150F; C152S; Q155K | 3.2 | B |
| 219/220 | E42G; S49T; S54P; I108V; E117G; S150F; C152S; Q155T; W156Q; F160P; C215G; I267V | 4.8 | B |
| 221/222 | P33L; E42G; P48G; S54P; S150F; C152S; Q155T; C215H | 5.6 | B |
| 223/224 | G36C; E42G; S54P; S150F; C152S; Q155K; C215H; A241R | 7.6 | B |
| 225/226 | G36C; E42G; P48K; S54P; S150F; C152S; Q155T; C215H | 4.8 | B |
| 227/228 | G36C; E42G; P48G; S54P; S150F; C152S; Q155I; C215H | 6.8 | B |
| 229/230 | E42G; S54P; I108V; S150F; C152S; Q155K; C215H | 9.2 | B |
| 231/232 | E42G; P48G; S54P; S150F; C152S; Q155T | 6.0 | B |
| 233/234 | E42G; S54P; S150F; C152S; Q155L; C215H | 6.4 | B |
| 235/236 | G36C; E42G; S54P; S150F; C152S; Q155I; C215H; A241R | 13.2 | B |
| 237/238 | G36C; E42G; P48K; S54P; S150F; C152S; Q155I; C215H | 9.6 | B |
| 239/240 | E42G; S54P; S150F; C152S; Q155I; C215H | 14.8 | B |
| 241/242 | G36C; E42G; S54P; S150F; C152S; Q155T; A241R | 13.6 | B |
| 243/244 | G36C; E42G; S54P; S150F; C152S; Q155V; C215H | 6.8 | B |
| 245/246 | P33L; E42G; S54P; S150F; C152S; Q155K; W156Q; C215H | 1.513 | C |
| 247/248 | E42G; P48S; S54P; S150F; C152S; Q155L; W156Q; C215H | 1.469 | C |
| 249/250 | P33L; E42G; S54P; S150F; C152S; Q155L; W156Q; C215H | 1.481 | C |
| 251/252 | P33L; E42G; S54P; A109S; S150F; C152S; Q155K; W156Q; C215H | 1.429 | C |
| 253/254 | P33L; E42G; S54P; S150F; C152S; Q155L; W156Q; C215H; A241R | 1.47 | C |
| 255/256 | I41F; E42G; S54P; S150F; C152S; Q155L; W156Q; C215G | 1.295 | C |
| 257/258 | I41F; E42G; S54P; M122Q; S150F; C152T; Q155V; W156Q; C215G | 1.213 | C |
| 259/260 | E42G; S54P; M122Q; S150F; C152T; Q155V; W156Q; V171I; C215G; A241R | 1.667 | C |
| 261/262 | I41F; E42G; S54P; S150F; C152S; Q155I; W156Q; V171I; C215G | 1.333 | C |
| 263/264 | I41F; E42G; S54P; S150F; C152S; Q155L; W156Q; V171I; C215G; A241R | 1.245 | C |
| 265/266 | E42G; S54P; S150F; C152S; Q155I; W156Q; V171I; C215G; A241R | 1.307 | C |
| 267/268 | I41F; E42G; S54P; S150F; C152S; Q155I; W156Q; C215G | 1.28 | C |
| 269/270 | P33L; E42G; S54P; S150F; C152S; Q155I; W156Q; C215G | 1.22 | C |
| 271/272 | I41F; E42G; S54P; S150F; C152S; Q155I; W156Q; V171I; C215G | 1.545 | C |
| 273/274 | E42G; S54P; M122Q; S150F; C152S; Q155I; W156Q; C215G; A241R | 1.605 | C |

TABLE 2A-continued

HTP Activity

| SEQ ID NO: (nt/aa) | Amino Acid Differences (compared to SEQ ID NO: 2) | Activity Fold-Improvement[1] | Assay Reaction Conditions[2] |
|---|---|---|---|
| 275/276 | E42G; S54P; M122Q; S150F; C152S; Q155L; W156Q; V171I; C215G; A241R | 1.248 | C |
| 277/278 | E42G; S54P; T69S; S150F; C152S; Q155L; W156Q; C215G | 1.57 | C |
| 279/280 | E42G; S54P; S150F; C152S; Q155L; W156Q; C215G; T283S | 1.573 | C |
| 281/282 | E42G; S54P; S150F; C152S; Q155L; W156Q; C215G; S282V; G284I | 1.507 | C |
| 283/284 | E42G; S54P; F136Y; S150F; C152S; Q155L; W156Q; C215G; S282V; G284P | 1.337 | C |
| 285/286 | E42G; S54P; S150F; C152S; Q155L; W156Y; C215G | 1.5 | C |
| 287/288 | E42G; S54P; F136I; S150F; C152S; Q155L; W156Y; C215G; S282V; G284I | 1.367 | C |
| 289/290 | E42G; S54P; S150F; C152S; Q155L; W156Q; C215G; G284I | 1.496 | C |
| 291/292 | E42G; S54P; F136I; S150F; C152S; Q155L; W156Q; C215G | 1.636 | C |
| 293/294 | E42G; S54P; F136I; S150F; C152S; Q155L; W156Q; C215G; G224I | 1.391 | C |
| 295/296 | E42G; S54P; F136I; S150F; C152S; Q155L; W156Y; C215G; G284P | 1.366 | C |
| 297/298 | E42G; S54P; P135I; F136Y; S150F; C152S; Q155L; W156Q; W192F; C215G | 1.438 | C |
| 299/300 | E42G; S54P; T126M; S150F; C152S; Q155L; W156Q; C215G | 1.389 | C |
| 301/302 | E42G; S54P; S150F; C152S; Q155L; W156Q; G193M; C215G | 1.54 | C |
| 303/304 | E42G; S54P; T68A; S150F; C152S; Q155L; W156Q; C215G | 1.473 | C |
| 305/306 | E42G; S54P; F60V; S150F; C152S; Q155L; W156Q; C215G | 1.405 | C |

[1]Activity Fold-Improvement was calculated as the percent conversion of the substrate of compound (2) to the product compound (1) by the specified engineered polypeptide under the activity assay reaction conditions (noted below and in Examples) per the percent conversion of the same substrate to product under the same reaction conditions by the engineered polypeptide of SEQ ID NO: 2. Percent conversion of substrate compound (2) to product (1) was determined by HPLC analysis of the quenched assay samples prepared as noted below and in Example 1. Percent conversion was quantified by dividing areas of HPLC product peaks by the sum of the areas of the product and substrate peaks.
[2]Activity Assay Reaction Conditions:
Conditions A
Lysis: Cells were lysed by shaking for 2 h at 250 rpm and room temperature in 200 uL of lysis buffer containing 0.1M TEA, 1 g/L lysozyme, and 0.5 g/L polymyxin B sulfate, and 0.25 mM PLP, at pH 8.5.
Enzymatic reaction: 40 μL clear cell lysate added to 140 μL volume of stock premix of 1.4 mM PLP (in sterile water), 2.1M isopropylamine (IPM), in 57% (v/v) DMSO, at pH 11; then reaction started by addition of 20 μL of 500 g/L substrate compound (2) in 100% DMSO. Final assay concentration: 50 g/L substrate compound (2), 1.5M IPM, 1 mM PLP, and 50% DMSO, at pH 11. Reaction plate was heat-sealed and shaken at 200 rpm at 55° C. for 18 h. Reaction was quenched by addition of 1 mL acetonitrile and shaking for 5 minutes, followed by centrifuge of plate for 10 min at 4000 x g at 18° C.
Conditions B
Lysis: Cells were lysed by shaking for 2 h at 250 rpm and room temperature in 200 uL of lysis buffer containing 0.1M TEA, 1 g/L lysozyme, and 0.5 g/L polymyxin B sulfate, and 0.25 mM PLP, at pH 8.5.
Enzymatic reaction: 20 μL clear cell lysate added to 160 μL volume of stock premix of 1.25 mM PLP (in sterile water), 2.5M isopropylamine (IPM), in 57% (v/v) DMSO, at pH 11.5; then reaction started by addition of 20 μL of 500 g/L substrate compound (2) in 100% DMSO. Final assay concentration: 50 g/L substrate compound (2), 2M IPM, 1 mM PLP, and 50% DMSO, at pH 11.5. Reaction plate was heat-sealed and shaken at 200 rpm at 55° C. for 18 h. Reaction was quenched by addition of 1 mL acetonitrile and shaking for 5 minutes, followed by centrifuge of plate for 10 min at 4000 x g at 18° C.
Conditions C
Lysis: Cells were lysed by shaking for 2 h at 250 rpm and room temperature in 200 uL of lysis buffer containing 0.1M TEA, 1 g/L lysozyme, and 0.5 g/L polymyxin B sulfate, and 0.25 mM PLP, at pH 8.5.
Enzymatic reaction: 10 μL clear cell lysate added to 180 μL volume of stock premix of 1.33 mM PLP (in sterile water), 2.2M isopropylamine (IPM), in 55.5% (v/v) DMSO, at pH 11.5; then reaction started by addition of 10 μL of 1000 g/L substrate compound (2) in 100% DMSO. Final assay concentration: 50 g/L substrate compound (2), 2M IPM, 1.2 mM PLP, and 50% DMSO, at pH 11.5. Reaction plate was heat-sealed and shaken at 200 rpm at 55° C. for 4 h. Reaction was quenched by addition of 1 mL acetonitrile and shaking for 5 minutes, followed by centrifuge of plate for 10 min at 4000 x g at 18° C.

TABLE 2B

SEP Activity and Stability

| SEQ ID NO: (nt/aa) | Amino Acid Differences (compared to SEQ ID NO: 2) | % Conv.[1] (50° C.) | % Conv.[2] (55° C.) | % Conv.[3] (60° C.) | % Conv.[4] (55° C., 2 h) | % e.e.[2] (55° C.) |
|---|---|---|---|---|---|---|
| 1/2 | None | n.d. | 4.8 | n.d. | n.d. | 99.9 |
| 39/40 | M122Q; | n.d. | 11.5 | n.d. | n.d. | 99.9 |
| 61/62 | E42G; S54P; C152S; Q155T; | n.d. | 11.8 | n.d. | n.d. | 99.9 |
| 69/70 | E42G; S54P; S150F; C152S; Q155T; I267V; | n.d. | 15.8 | n.d. | n.d. | 99.9 |
| 77/78 | E42G; S54P; S150F; C152S; Q155T; | 74.6 | 27.8 | 18.6 | n.d. | 99.9 |
| 121/122 | E42G; S54P; S150F; C152S; Q155T; C215G; I267V; | 72.6 | 53.6 | 48.6 | n.d | n.d. |

TABLE 2B-continued

SEP Activity and Stability

| SEQ ID NO: (nt/aa) | Amino Acid Differences (compared to SEQ ID NO: 2) | % Conv.[1] (50° C.) | % Conv.[2] (55° C.) | % Conv.[3] (60° C.) | % Conv.[4] (55° C., 2 h) | % e.e.[2] (55° C.) |
|---|---|---|---|---|---|---|
| 129/130 | E42G; S54P; S150F; C152S; Q155L; W156Q; C215G; | 72.5 | 64.4 | 62.7 | 8.6 | n.d. |
| 159/160 | P33L; E42G; S42P; E117G; S150F; C152S; Q155I; W156Q; C215G; | 60.2 | 76.5 | 63.5 | n.d. | n.d. |
| 177/178 | I41K; E42G; S54P; S150F; C152S; Q155K; W156Q; C215G; | 66.1 | 54.4 | 46.1 | n.d. | n.d. |
| 191/192 | P33L; I41C; E42G; S54P; S150F; C152S; Q155K; F160P; C215G; | 79.1 | 6.4 | 0.1 | n.d. | n.d. |
| 245/246 | P133L; E42G; S54P; S150F; C152S; Q155K; W156Q; C215H; | n.d. | n.d. | n.d. | 14.29 | n.d. |
| 247/248 | E42G; P48G; S54P; S150F; C152S; Q155L; W156Q; C215H; | n.d. | n.d. | n.d. | 13.20 | n.d. |
| 249/250 | P33L; E42G; S54P; S150F; C152S; Q155L; W156Q; C215H; | n.d. | n.d. | n.d. | 14.61 | n.d. |
| 259/260 | E42G; S54P; M122Q; S150F; C152T; Q155V; W156Q; V171I; C215G; A241R; | n.d. | n.d. | n.d. | 11.40 | n.d. |
| 271/272 | I41F; E42G; S54P; S150F; C152S; Q155L; W156Q; V171I; C215G; | n.d. | n.d. | n.d. | 12.54 | n.d. |
| 273/274 | E42G; S54P; M122Q; S150F; C152S; Q155I; W156Q; C215G; A241R; | n.d. | n.d. | n.d. | 11.85 | n.d. |
| 291/292 | E42G; S54P; F136I; S150F; C152S; Q155L; W156Q; C215G; | n.d. | n.d. | n.d. | 10.42 | n.d. |

"n.d." = not determined
Percent conversion of substrate compound (2) to product (1) was determined by HPLC analysis of the quenched assay samples prepared as noted below and in Example 1. Percent conversion was quantified by dividing areas of HPLC product peaks by the sum of the areas of the product and substrate peaks.
[1]Reaction conditions for 50° C. SFP assay: 50 g/L substrate, 2 g/L SFP preparation of engineered polypeptide, 1 mM g/L pyridoxal-5'-phosphate (PLP), 1M isopropylamine (IPM), 50% v/v DMSO, pH 10.0. Total reaction volume: 5 mL.
[2]Reaction conditions for 55° C. SFP assay: 50 g/L substrate, 2 g/L SFP preparation of engineered polypeptide, 1 mM g/L pyridoxal-5'-phosphate (PLP), 2M isopropylamine (IPM), 50% v/v DMSO, pH 11.5. Total reaction volume: 5 mL.
[3]Reaction conditions for 60° C. SFP assay: 50 g/L substrate, 2 g/L SFP preparation of engineered polypeptide, 1 mM g/L pyridoxal-5'-phosphate (PLP), 2M isopropylamine (IPM), 50% v/v DMSO, pH 11.5. Total reaction volume: 5 mL.
[4]Reaction conditions for 55° C. SFP 2 h assay: 50 g/L substrate, 0.5, 1, or 2 g/L SFP preparation of engineered polypeptide, 1.2 mM g/L pyridoxal-5'-phosphate (PLP), 2M isopropylamine (IPM), 50% v/v DMSO, pH 11.5. Total reaction volume: 5 mL.

TABLE 2C

DSP Activity and Stability

| SEQ ID NO: (nt/aa) | Amino Acid Differences (compared to SEQ ID NO: 2) | 50° C. Assay % Conv.[1] (1.0 g/L enzyme) | 50° C. Assay % Conv.[2] (0.5 g/L enzyme) | % e.e. | 55° C. Assay % Conv.[3] (1.0 g/L enzyme) | 55° C. Assay % Conv.[4] (0.5 g/L enzyme) | % e.e. |
|---|---|---|---|---|---|---|---|
| 1/2 | None | 59.7 | 33.3 | 99.9 | 7.8 | 4.1 | 99.9 |
| 63/64 | E42G; S54P; C152S; Q155T; R164P; | 82.8 | 71.4 | 22.9 | 8.7 | 37.1 | 99.9 |

TABLE 2C-continued

| | | DSP Activity and Stability | | | | | |
|---|---|---|---|---|---|---|---|
| SEQ | Amino Acid | 50° C. Assay | | | 55° C. Assay | | |
| ID NO: (nt/aa) | Differences (compared to SEQ ID NO: 2) | % Conv.[1] (1.0 g/L enzyme) | % Conv.[2] (0.5 g/L enzyme) | % e.e. | % Conv.[3] (1.0 g/L enzyme) | % Conv.[4] (0.5 g/L enzyme) | % e.e. |
| 121/122 | E42G; S54P; S150F; C152S; Q155T; C215G; I267V; | 81.7 | 71.8 | 99.9 | 52.1 | 37.1 | 99.9 |
| 129/130 | E42G; S54P; S150F; C152S; Q155L; W156Q; C215G; | 83.5 | 72.8 | 99.9 | 68.4 | 54.3 | 99.9 |

Percent conversion of substrate compound (2) to product (1) was determined by HPLC analysis of the quenched assay samples prepared as noted below and in Example 1. Percent conversion was quantified by dividing areas of HPLC product peaks by the sum of the areas of the product and substrate peaks.
[1]Reaction conditions for 50° C., 1 g/L DSP assay: 50 g/L substrate compound (2), 1 g/L DSP preparation of engineered polypeptide, 1 mM g/L pyridoxal-5'-phosphate (PLP), 1M isopropylamine (IPM), 50% v/v DMSO, pH 10.0, 50° C.. Total reaction volume: 5 mL.
[2]Reaction conditions for 50° C., 0.5 g/L DSP assay: 50 g/L substrate compound (2), 0.5 g/L DSP preparation of engineered polypeptide, 1 mM g/L pyridoxal-5'-phosphate (PLP), 1M isopropylamine (IPM), 50% v/v DMSO, pH 10. Total reaction volume: 5 mL.
[3]Reaction conditions for 55° C., 1 g/L SFP assay: 50 g/L substrate compound (2), 1 g/L DSP preparation of engineered polypeptide, 1 mM g/L pyridoxal-5'-phosphate (PLP), 2M isopropylamine (IPM), 50% v/v DMSO, pH 11.5. Total reaction volume: 5 mL.
[4]Reaction conditions for 55° C., 0.5 g/L SPF assay: 50 g/L substrate compound (2), 0.5 g/L DSP preparation of engineered polypeptide, 1 mM g/L pyridoxal-5'-phosphate (PLP), 2M isopropylamine (IPM), 50% v/v DMSO, pH 11.5. Total reaction volume: 5 mL.

As shown in Tables 2A-2C, the exemplary engineered polypeptides having transaminase activity of the even-numbered sequence identifiers of SEQ ID NO:4-306 include one or more of the following residue differences as compared to SEQ ID NO:2: X5K, X33L, X36C, X41C/F/K/M/N/R, X42A/G, X44Q, X48D/E/G/K/T, X49T. X51K, X54P, X55L, X76S, X108V, X117G, X122F/Q, X126A, X148Q, X150A/F, X152S/T, X155A/I/K/L/T/V, X156Q/R/S, X160P, X164P, X165N, X182T, X215G/H/L, X218M, X241R, X267V, X270T, X273H, X325M, and X328I. Based on the properties of the exemplary engineered polypeptides of SEQ ID NO:4-306 disclosed in Tables 2A-2C (and Example 1), improved enzyme properties such as increased activity for converting compound (2) to compound (1), increased thermal, solvent, and/or pH stability, are associated with at least the following residue differences as compared to SEQ ID NO:2: In some embodiments, the present disclosure provides an engineered polypeptide having transaminase activity comprising an amino acid sequence having at least 80% sequence identity to reference sequence of SEQ ID NO:2 and (a) an amino acid residue difference as compared to SEQ ID NO:2 selected from X33L, X36C, X41C/F/K/M/N/R, X42G, X48D/E/G/K/T, X51K, X54P, X76S, X122F/Q, X148Q, X152T, X155A/I/T/V, X156R, X160P, X215G/H/L, X241R, X270T, X273H, X325M; and X241R, and/or (b) a combination of residue differences selected from; X42G, X54P, X152S, and X155T; X42G, X54P, X152S, X155T, and R164P; X42G, X54P, X150F, X152S, and X155T; X42G, X54P, X150F, X152S, X155T, and X267V; X42G, X54P, X150F, X152S, X155L, W156Q, and C215G; X42G, X54P, X150F, X152S, X155T, X215G, and X267V; X33L; X42G, X54P, X117G; X150F, X152S, X155I, X156Q, and C215G; and X41K, X42G, X54P, X150F, X152S, X155K, X156Q, and C215G; X33L, X42G, X54P, X109S, X150F, X152S, X155K, X156Q, and X215H; X33L, X42G, X54P, X150F, X152S, X155I, X156Q, and X215G; X33L, X42G, X54P, X150F, X152S, X155K, X156Q, and X215H; X33L, X42G, X54P, X150F, X152S, X155L, X156Q, and X215H; X33L, X42G, X54P, X150F, X152S, X155L, X156Q, X215H, and X241R; X41F, X42G, X54P, X122Q, X150F, X152T, X155V, X156Q, and X215G; X41F, X42G, X54P, X150F, X152S, X155L, X156Q, X171I, X215G, and X241R; X41F, X42G, X54P, X150F, X152S, X155L, X156Q, V171I, and X215G; X41F, X42G, X54P, X150F, X152S, X155I, X156Q, and X215G; X41F, X42G, X54P, X150F, X152S, X155L, X156Q, X171I, and X215G; X41F, X42G, X54P, X150F, X152S, X155L, X156Q, and X215G; X42G, X48G, X54P, X150F, X152S, X155L, X156Q, and X215H; X42G, X54P, X60V, X150F, X152S, X155L, X156Q, and X215G; X42G, X54P, X68A, X150F, X152S, X155L, X156Q, and X215G; X42G, X54P, X69S, X150F, X152S, X155L, X156Q, and X215G; X42G, X54P, X122Q, X150F, X152S, X155I, X156Q, X215G, and X241R; X42G, X54P, X122Q, X150F, X152S, X155L, X156Q, X171I, X215G, and X241R; X42G, X54P, X122Q, X150F, X152T, X155V, X156Q, X171I, X215G, and X241R; X42G, X54P, X126M, X150F, X152S, X155L, X156Q, and X215G; X42G, X54P, X135I, X136Y, X150F, X152S, X155L, X156Q, X192F, and X215G; X42G, X54P, X136I, X150F, X152S, X155L, X156Q, and X215G; X42G, X54P, X136I, X150F, X152S, X155L, X156Q, X215G, and X224I; X42G, X54P, X136I, X150F, X152S, X155L, X156Y, X215G, X282V, and X284I; X42G, X54P, X136I, X150F, X152S, X155L, X156Y, X215G, and X284P; X42G, X54P, X136Y, X150F, X152S, X155L, X156Q, X215G, X282V, and X284P; X42G, X54P, X150F, X152S, X155I, X156Q, X171I, X215G, and X241R; X42G, X54P, X150F, X152S, X155L, X156Q, X193M, and X215G; X42G, X54P, X150F, X152S, X155L, X156Q, X215G, X282V, and X284I; X42G, X54P, X150F, X152S, X155L, X156Q, X215G, and X283S; X42G, X54P, X150F, X152S, X155L, X156Q, X215G, and X284I; and X42G, X54P, X150F, X152S, X155L, X156Y, and X215G, As will be apparent to the skilled artisan, the foregoing residue positions and the specific amino acid residues for each residue position can be used individually or in various combinations to synthesize transaminase polypeptides having desired improved properties, including, among others, enzyme activity, substrate/product preference, stereoselectivity, substrate/product tolerance, and stability under various conditions, such as increased temperature, solvent, and/or pH.

In light of the guidance provided herein, it is further contemplated that any of the exemplary engineered polypeptides having the even-numbered sequence identifiers of SEQ ID NO:4-306 can be used as the starting amino acid sequence for synthesizing other engineered transaminase polypeptides, for example by subsequent rounds of evolution by adding in new combinations of various amino acid differences from other polypeptides in Tables 2A. 2B, and 2C. and other residue positions described herein. Further improvements may be generated by including amino acid differences at positions that had been maintained as unchanged throughout earlier rounds of evolution.

Accordingly, in some embodiments, the present disclosure provides an engineered polypeptide having transaminase activity comprising an amino acid sequence having at least 80%, 85%, 86%, 87%, 88%, 89%, 90%, 91%, 92%, 93%, 94%, 95%, 96%, 97%. 98%, 99% or more identity to reference sequence SEQ ID NO:2 and In some embodiments, the present disclosure provides an engineered polypeptide having transaminase activity comprising an amino acid sequence having at least 80% sequence identity to reference sequence of SEQ ID NO:2 and (a) an amino acid residue difference as compared to SEQ ID NO:2 selected from X33L, X36C, X41C/F/M N/R, X42G, X48D/E/G/K/T, X51K, X54P, X76S, X122F/Q, X148Q, X152T, X155A/I/K/T/V, X156R, X160P, X215G/H/L, X241R, X270T, X273H, X325M; and X241R, and/or (b) a combination of residue differences selected from: X42G, X54P, X152S, and X155T; X42G, X54P, X152S, X155T, and R164P; X42G, X54P, X150F, X152S, and X155T; X42G, X54P, X150F, X152S, X155T, and X267V; X42G, X54P, X150F, X152S, X155L, W156Q, and C215G; X42G, X54P, X150F, X152S, X155T, X215G, and X267V; X33L; X42G, X54P, X117G; X150F, X152S, X155I, X156Q, and C215G; and X41K, X42G, X54P, X150F, X152S, X155K, X156Q, and C215G; X33L, X42G, X54P, X109S, X150F, X152S, X155K, X156Q, and X215H; X33L, X42G, X54P, X150F, X152S, X155I, X156Q, and X215G; X33L, X42G, X54P, X150F, X152S, X155K, X156Q, and X215H; X33L, X42G, X54P, X150F, X152S, X155L, X156Q, and X215H; X33L, X42G, X54P, X150F, X152S, X155L, X156Q, X215H, and X241R; X41F, X42G, X54P, X122Q, X150F, X152T, X155V, X156Q, and X215G; X41F, X42G, X54P, X150F, X152S, X155L, X156Q, X171I, X215G, and X241R; X41F, X42G, X54P, X150F, X152S, X155I, X156Q, V171I, and X215G; X41F, X42G, X54P, X150F, X152S, X155I, X156Q, and X215G; X41F, X42G, X54P, X150F, X152S, X155L, X156Q, X171I, and X215G; X42G, X48G, X54P, X150F, X152S, X155L, X156Q, and X215H; X42G, X54P, X60V, X150F, X152S, X155L, X156Q, and X215G; X42G, X54P, X68A, X150F, X152S, X155L, X156Q, and X215G; X42G, X54P, X69S, X150F, X152S, X155L, X156Q, and X215G; X42G, X54P, X122Q, X150F, X152S, X155I, X156Q, X215G, and X241R; X42G, X54P, X122Q, X150F, X152S, X155L, X156Q, X171I, X215G, and X241R; X42G, X54P, X122Q, X150F, X152T, X155V, X156Q, X171I, X215G, and X241R; X42G, X54P, X126M, X150F, X152S, X155L, X156Q, and X215G; X42G, X54P, X135I, X136Y, X150F, X152S, X155L, X156Q, X192F, and X215G; X42G, X54P, X136I, X150F, X152S, X155L, X156Q, and X215G; X42G, X54P, X136I, X150F, X152S, X155L, X156Q, X215G, and X224I; X42G, X54P, X136I, X150F, X152S, X155L, X156Y, X215G, X282V, and X284I; X42G, X54P, X136I, X150F, X152S, X155L, X156Y, X215G, and X284P; X42G, X54P, X136Y, X150F, X152S, X155L, X156Q, X215G, X282V, and X284P; X42G, X54P, X150F, X152S, X155I, X152S, X155L, X156Q, X193M, and X215G; X42G, X54P, X150F, X152S, X155L, X156Q, X215G, X282V, and X284I; X42G, X54P, X150F, X152S, X155L, X156Q, X215G, and X283S; X42G, X54P, X150F, X152S, X155L, X156Q, X215G, and X284I; and X42G, X54P, X150F, X152S, X155L, X156Y, and X215G, In some embodiments, the engineered polypeptide having transaminase activity comprises an amino acid sequence an amino acid sequence having at least 80%, 85%, 86%, 87%, 88%, 89%, 90%, 91%, 92%, 93%, 94%, 95%, 96%, 97%, 98%, 99% or more identity to a reference sequence selected from the even-numbered sequence identifiers of SEQ ID NO:4-306, and (a) one or more amino acid residue differences selected from In some embodiments, the present disclosure provides an engineered polypeptide having transaminase activity comprising an amino acid sequence having at least 80% sequence identity to reference sequence of SEQ ID NO:2 and (a) an amino acid residue difference as compared to SEQ ID NO:2 selected from X33L, X36C, X41C/F/M/N/R, X42G, X48D/E/G/K/T, X51K, X54P, X76S, X122F/Q, X148Q, X152T, X155A/I/K/T/V, X156R. X160P, X215G/H/L, X241R, X270T. X273H, X325M; and X241R, and/or (b) a combination of residue differences selected from: X42G, X54P, X152S, and X155T; X42G, X54P, X152S, X155T, and R164P; X42G, X54P, X150F, X152S, and X155T; X42G, X54P, X150F, X152S, X155T, and X267V; X42G, X54P, X150F, X152S, X155L, W156Q, and C215G; X42G, X54P, X150F, X152S, X155T, X215G, and X267V; X33L; X42G, X54P, X117G; X150F, X152S, X155I, X156Q, and C215G; and X41K, X42G, X54P, X150F, X152S, X155K, X156Q, and C215G; X33L, X42G, X54P, X109S, X150F, X152S, X155K, X156Q, and X215H; X33L, X42G, X54P, X150F, X152S, X155I, X156Q, and X215G; X33L, X42G, X54P, X150F, X152S, X155K, X156Q, and X215H; X33L, X42G, X54P, X150F, X152S, X155L, X156Q, and X215H; X33L, X42G, X54P, X150F, X152S, X155L, X156Q, X215H, and X241R; X41F, X42G, X54P, X122Q, X150F, X152T, X155V, X156Q, and X215G; X41F, X42G, X54P, X150F, X152S, X155L, X156Q, X171I, X215G, and X241R; X41F, X42G, X54P, X150F, X152S, X155I, X156Q, V171I, and X215G; X41F, X42G, X54P, X150F, X152S, X155I, X156Q, and X215G; X41F, X42G, X54P, X150F, X152S, X155L, X156Q, X171I, and X215G; X41F, X42G, X54P, X150F, X152S, X155L, X156Q, and X215G; X42G, X48G, X54P, X150F, X152S, X155L, X156Q, and X215H; X42G, X54P, X60V, X150F, X152S, X155L, X156Q, and X215G; X42G, X54P, X68A, X150F, X152S, X155L, X156Q, and X215G; X42G, X54P, X69S, X150F, X152S, X155L, X156Q, and X215G; X42G, X54P, X122Q, X150F, X152S, X155I, X156Q, X215G, and X241R; X42G, X54P, X122Q, X150F, X152S, X155L, X156Q, X171I, X215G, and X241R; X42G, X54P, X122Q, X150F, X152T, X155V, X156Q, X171I, X215G, and X241R; X42G, X54P, X126M, X150F, X152S, X155L, X156Q, and X215G; X42G, X54P, X135I, X136Y, X150F, X152S, X155L, X156Q, X192F, and X215G; X42G, X54P, X136I, X150F, X152S, X155L, X156Q, and X215G; X42G, X54P, X136I, X150F, X152S, X155L, X156Q, X215G, and X224I; X42G, X54P, X136I, X150F, X152S, X155L, X156Y, X215G, X282V, and X284I; X42G, X54P, X136I, X150F, X152S, X155L, X156Y, X215G, and X284P; X42G, X54P, X136Y, X150F, X152S, X155L, X156Q, X215G, X282V, and X284P; X42G, X54P, X150F, X152S, X155I, X152S, X155L, X156Q, X171I, X215G, and X241R; X42G, X54P, X150F, X152S, X155L, X156Q, X193M, and X215G; X42G, X54P, X150F, X152S, X155L, X156Q, X215G, X282V, and X284I; X42G, X54P, X150F, X152S, X155L, X156Q, X215G, and X283S; X42G, X54P, X150F, X152S, X155L, X156Q, X215G, and X284I; and X42G, X54P, X150F, X152S, X155L, X156Y, and X215G.

In some embodiments, the reference sequence is selected from SEQ ID NO:4, 40, 62, 64, 70, 78, 122, 130, 160, 178, and 192. In some embodiments, the reference sequence is SEQ ID NO:4. In some embodiments, the reference sequence is SEQ ID NO:40. In some embodiments, the reference sequence is SEQ ID NO:62. In some embodiments, the reference sequence is SEQ ID NO:64. In some embodiments, the reference sequence is SEQ ID NO:70. In some embodiments, the reference sequence is SEQ ID NO:78. In some embodiments, the reference sequence is SEQ ID NO:122. In some embodiments, the reference sequence is SEQ ID NO: 130. In some embodiments, the reference sequence is SEQ ID NO:160. In some embodiments, the reference sequence is SEQ ID NO:178. In some embodiments, the reference sequence is SEQ ID NO: 192.

In some embodiments, the engineered polypeptide having transaminase activity comprises an amino acid sequence having at least 80%, 85%, 86%, 87%, 88%, 89%, 90%, 91%, 92%, 93%, 94%, 95%, 96%. 97%, 98%, or 99% identity to one of the sequences having the even-numbered sequence identifiers of SEQ ID NO:4-306, and the combination of amino acid residue differences as compared to SEQ ID NO:2 present in any one of the sequences having the even-numbered sequence identifiers of SEQ ID NO:4-306. In some embodiments, the engineered polypeptide having transaminase activity comprises an amino acid sequence selected from the even-numbered sequence identifiers of SEQ ID NO:4-306.

In addition to the residue positions specified above, any of the engineered transaminase polypeptides disclosed herein can further comprise residue differences relative to the reference polypeptide sequence of SEQ ID NO:2 at other residue positions i.e., residue positions other than X5, X33, X36, X41, X42, X44, X48, X49, X51, X54, X55, X76, X108, X117, X122, X126, X148, X150, X152, X155, X156, X160, X164, X165, X182, X215, X218, X241, X267, X270, X273, X325, and X328. Residue differences at these other residue positions can provide for additional variations in the amino acid sequence without altering the polypeptide's transaminase activity. Accordingly, in some embodiments, in addition to the amino acid residue differences of any one of the engineered transaminase polypeptides selected from the polypeptides having the even-numbered sequence identifiers of SEQ ID NO:4-306, the sequence can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, or 1-60 residue differences at other amino acid residue positions as compared to the SEQ ID NO:2. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, or 60 residue positions. In some embodiments, the residue differences at other amino acid residue positions can comprise conservative substitutions and/or non-conservative substitutions as compared to a reference sequence of the wild-type polypeptide of SEQ ID NO:2 or the engineered polypeptide of SEQ ID NO:2.

Amino acid residue differences at other positions relative to the wild-type sequence of SEQ ID NO:2 and the affect of these differences on enzyme function are described for other engineered transaminase polypeptides disclosed in U.S. Pat. No. 8,293,507 B2, issued Oct. 23, 2012, PCT Publication WO2011005477A1, published Jan. 13, 2011, and PCT publication WO2012024104, published Feb. 23, 2012; each of which are incorporated by reference herein. Accordingly, in some embodiments, one or more of the amino acid differences as compared to the wild-type sequence of SEQ ID NO:2 can also be introduced into a engineered transaminase polypeptide of the present disclosure at residue positions selected from X2; X4; X5; X7; X8; X9; X10; X11; X14; X18; X22; X25; X26; X27; X28; X30; X37; X38; X41; X44; X48; X49; X50; X55; X58; X60; X65; X81; X82; X94; X96L; X102; X108; X120; X135; X137; X138; X141; X142; X146; X148; X163; X163; X164; X169; X171; X178; X181; X182; X204; X209; X210; X211; X213; X215; X217; X218; X223; X225; X230; X242; X245; X252; X265; X292; X297; X302; X306; X321; X328 and X329. In particular, the choices of amino acid residues at the foregoing positions can be selected from the following: X2K/Q/S; X4I/Y; X5K/H/I/L/N/S/T/V; X7A; X8P/T; X9N/Q/S; X10V; X11K; X14R; X18C; X22I; X25Q; X26H; X27T; X28P; X30M/Q; X37R; X38G; X41H/S/F; X44Q/V; X48A/D/G/Q/V; X49T; X50L; X55V/L; X58L; X60F; X65A/T/C/G/S; X81G; X82S; X94I/L; X96L; X102L/K; X108V; X120Y; X135Q; X137T/I; X138K/P; X141L; X142R/T; X146R; X148A/F; X163H/V; X164P/V/A; X169L; X171A; X178S; X181G; X182T; X204A; X209L/C/D/E; X210S; X211; X213P; X215F/Y/C; X217N/S; X218M; X223I/L/M/N/P; X225Y; X230V; X242T; X245S; X252F; X265T; X292T; X297S; X302A; X306L; X321P; X328I; and X329H. Further guidance on the choice of the amino acid residues at the residue positions can be found in the cited references.

As discussed above, the engineered polypeptide sequence of SEQ ID NO:2 used as the starting backbone for generating the exemplary engineered transaminase polypeptides is also an engineered transaminase polypeptide having the following 28 amino acid differences relative to the naturally occurring transaminase of *Arthrobacter* sp. KNK168 (GenBank Ace. No. BAK39753.1. GI:336088341): S8P, Y60F, L61Y, H62T, V65A, V69T, D81G, M94I, I96L, F122M, S124T, S126T, G136F, Y150S, V152C, A169L, V199I, A209L, G215C, G217N, S223P, L269P, L273Y, T282S, A284G, P297S, I306V, and S321P. Thus, in some embodiments, the engineered polypeptides having transaminase activity comprising an amino acid sequence having at least 80%, 85%, 86%, 87%, 88%, 89%, 90%, 91%, 92%, 93%, 94%. 95%, 96%, 97%, 98%, or 99% identity to a reference amino acid sequence selected from any one of the sequences having the even-numbered sequence identifiers of SEQ ID NO:4-306, has an amino acid sequence that does not include a residue difference as compared to SEQ ID NO:2 at one or more of the following positions: X8; X60; X61; X62; X65; X81; X94; X96; X122; X124; X136; X169; X199; X209; X215; X217; X223; X269; X273; X282; X284; X297; X306; and X321.

In some embodiments, the present disclosure also provides engineered transaminase polypeptides that comprise a fragment of any of the engineered transaminase polypeptides described herein that retains the functional transaminase activity and/or improved property of that engineered transaminase polypeptide. Accordingly, in some embodiments, the present disclosure provides a polypeptide fragment having transaminase activity (e.g., capable of converting compound (2) to compound (1) under suitable reaction conditions), wherein the fragment comprises at least about 80%, 90%, 95%, 98%, or 99% of a full-length amino acid sequence of an engineered polypeptide of the present disclosure, such as an exemplary engineered polypeptide of having the even-numbered sequence identifiers of SEQ ID NO:4-306.

In some embodiments, the engineered transaminase polypeptide of the disclosure can have an amino acid sequence comprising a deletion as compared to any one of the engineered transaminase polypeptide sequences described herein, such as the exemplary engineered polypeptide sequences having the even-numbered sequence identifiers of SEQ ID NO:4-306. Thus, for each and every embodiment of the engineered transaminase polypeptides of the disclosure, the amino acid sequence can comprise deletions of one or more amino acids, 2 or more amino acids, 3 or more amino acids, 4 or more amino acids. 5 or more amino acids. 6 or more amino acids. 8 or more amino acids. 10 or more amino acids. 15 or more amino acids, or 20 or more amino acids, up to 10% of the total number of amino acids, up to 10% of the total number of amino acids, up to 20% of the total number of amino acids, or up to 30% of the total number of amino acids of the transaminase polypeptides, where the associated functional activity and/or improved properties of the engineered transaminase described herein is maintained. In some embodiments, the deletions can comprise, 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, 1-50, 1-55, or 1-60 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, or 60 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, 25 or 30 amino acid residues.

In some embodiments, the present disclosure provides an engineered transaminase polypeptide having an amino acid sequence comprising an insertion as compared to any one of the engineered transaminase polypeptide sequences described herein, such as the exemplary engineered polypeptide sequences having the even-numbered sequence identifiers of SEQ ID NO:4-306. Thus, for each and every embodiment of the transaminase polypeptides of the disclosure, the insertions can comprise one or more amino acids. 2 or more amino acids. 3 or more amino acids. 4 or more amino acids. 5 or more amino acids, 6 or more amino acids, 8 or more amino acids, 10 or more amino acids, 15 or more amino acids, or 20 or more amino acids, where the associated functional activity and/or improved properties of the engineered transaminase described herein is maintained. The insertions can be to amino or carboxy terminus, or internal portions of the transaminase polypeptide.

In some embodiments, the present disclosure provides a engineered polypeptides having transaminase activity, which comprise an amino acid sequence having at least 80%, 85%, 86%, 87%, 88%, 89%, 90%, 91%, 92%, 93%, 94%, 95%, 96%, 97%, 98%, or 99% identity to the sequences having the even-numbered sequence identifiers of SEQ ID NO:4-306, with the proviso that the amino acid sequence is not identical to (that is, it excludes) any of the exemplary engineered transaminase polypeptides amino acid sequences disclosed in U.S. Pat. No. 8,293,507 B2, issued Oct. 23, 2012, PCT Publication WO2011005477A1, published Jan. 13, 2011, PCT publication WO2012024104, published Feb. 23, 2012, and PCT Appl. No. PCT/US 12/54300, filed Sep. 7, 2012, each of which is hereby incorporated by reference herein.

In some embodiments, the engineered polypeptides having transaminase activity of the present disclosure also are capable of converting a substrate compound of Formula (II), Formula (IIa), compound (2), and/or compound (4) to a corresponding amine product compound of Formula (I), Formula (Ia), compound (1) and/or compound (3), respectively. In some embodiments, the engineered polypeptides have improved activity and/or stability relative to the activity and/or stability of the engineered polypeptide of SEQ ID NO:2 in converting a substrate compound of Formula (II), Formula (IIa), and/or compound (2) to a corresponding amine product compound of Formula (I). Formula (Ia), and/or compound (1), under suitable reaction conditions. In particular, reaction conditions useful for the industrial scale production of such compounds.

In the above embodiments, the suitable reaction conditions for the engineered polypeptides are those described in Tables 2A, 2B, and 2C. Accordingly, in some embodiments, the suitable reaction conditions comprise: (a) substrate loading of about 10 to 200 g/L of substrate compound of Formula (II), Formula (IIa), compound (2), or compound (4); (b) engineered polypeptide concentration of about 0.5 g/L to 5 g/L; (c) IPM concentration of about 0.1 to 3 M; (d) PLP cofactor concentration of about 0.1 to 1 mM; (e) DMSO concentration of about 30% (v/v) to about 60% (v/v); (f) pH of about 9.5 to 11.5; and (g) temperature of about 45° C. to 60° C. In some embodiments, the suitable reaction conditions comprise: (a) about 50 g/L of substrate compound of Formula (II), Formula (IIa), compound (2), or compound (4); (b) about 2 g/L engineered polypeptide; (c) about 50% (v/v) dimethylsulfoxide (DMSO); (d) about 1 M isopropylamine (IPM); (e) about 1 mM pyridoxal phosphate (PLP); (0 about pH 10; and (g) about 50° C. Guidance for use of these reaction conditions and the transaminase polypeptides are provided in, among others, Tables 2A, 2B, and 2C, and the Examples.

In some embodiments, the polypeptides of the disclosure can be in the form of fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

The engineered transaminase polypeptides described herein are not restricted to the genetically encoded amino acids. Thus, in addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-stereoisomers of the genetically-encoded amino acids: 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf);

2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (lnAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (Sff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(ω)-nitroarginine (nArg); homolysine (hLys); phosphonomethylphenylalanine (pmPhe); phosphoserine (pSer); phosphothreonine (pThr); homoaspartic acid (hAsp); homoglutamic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisoleucine (hbile); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (see, e.g., the various amino acids provided in Fasman, 1989, CRC Practical Handbook of Biochemistry and Molecular Biology. CRC Press. Boca Raton, Fla., at pp. 3-70 and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (nitropyridinesulfenyl), Glu(δ-benzylester), Gln(xanthyl), Asn(N-δ-xanthyl), His(bom), His (benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having transaminase activity are bound or immobilized on the solid support such that they retain their improved activity, enantioselectivity, stereoselectivity, and/or other improved properties relative to the reference polypeptide of SEQ ID NO:2. In such embodiments, the immobilized polypeptides can facilitate the biocatalytic conversion of the substrate compound of Formula (II). Formula (IIa), compound (2), and/or compound (4) to a corresponding amine product compound of Formula (I), Formula (Ia), compound (1), and/or compound (3), and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the engineered transaminase polypeptides of the present disclosure can be carried out using the same transaminase polypeptides bound or immobilized on a solid support.

The engineered transaminase polypeptide can be bound non-covalently or covalently. Various methods for conjugation and immobilization of enzymes to solid supports (e.g., resins, membranes, beads, glass, etc.) are well known in the art. In particular, PCT publication WO2012/177527 A1 immobilized engineered transaminase polypeptides capable of converting compound (2) to compound (1) (including the reference polypeptide of SEQ ID NO:2), and methods of preparing the immobilized polypeptides, in which the polypeptide is physically attached to a resin by either hydrophobic interactions or covalent bonds, and is stable in a solvent system that comprises at least up to 100% organic solvent. Other methods for conjugation and immobilization of enzymes to solid supports (e.g., resins, membranes, beads, glass, etc.) are well known in the art and described in e.g.: Yi et al., "Covalent immobilization of ω-transaminase from *Vibrio fluvialis* JS17 on chitosan beads." *Process Biochemistry* 42(5): 895-898 (May 2007); Martin et al., "Characterization of free and immobilized (S)-aminotransferase for acetophenone production." *Applied Microbiology and Biotechnology* 76(4): 843-851 (September 2007); Koszelewski et al., "Immobilization of ω-transaminases by encapsulation in a sol-gel/celite matrix," *Journal of Molecular Catalysis B: Enzymatic.* 63: 39-44 (April 2010); Truppo et al., "Development of an Improved Immobilized CAL-B for the Enzymatic Resolution of a Key Intermediate to Odanacatib." *Organic Process Research & Development*, published online: dx.doi.org/10.1021/op200157c; Hermanson, G. T., Bioconjugate Techniques, Second Edition, Academic Press (2008); Mateo et al., "Epoxy sepabeads: a novel epoxy support for stabilization of industrial enzymes via very intense multipoint covalent attachment." *Biotechnology Progress* 18(3):629-34 (2002); and Bioconjugation Protocols: Strategies and Methods, In Methods in Molecular Biology, C. M. Niemeyer ed., Humana Press (2004); the disclosures of each which are incorporated by reference herein.

Solid supports useful for immobilizing the engineered transaminase polypeptides of the present disclosure include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered transaminases of the present disclosure include, but are not limited to, chitosan beads, Eupergit C, and SEPA-BEADs (Mitsubishi), including the following different types of SEPABEAD: EC-EP, EC-HFA/S, EXA252. EXE119 and EXE120.

In some embodiments, the engineered transaminase polypeptides can be provided in the form of an array in which the polypeptides are arranged in positionally distinct locations. In some embodiments, the positionally distinct locations are wells in a solid support such as a 96-well plate. A plurality of supports can be configured on an array at various locations, addressable for robotic delivery of reagents, or by detection methods and/or instruments. Such arrays can be used to test a variety of substrate compounds for conversion by the polypeptides.

In some embodiments, the engineered polypeptides described herein can be provided in the form of kits. The polypeptides in the kits may be present individually or as a plurality of polypeptides. The kits can further include reagents for carrying out enzymatic reactions, substrates for assessing the activity of polypeptides, as well as reagents for detecting the products. The kits can also include reagent dispensers and instructions for use of the kits. In some embodiments, the kits of the present disclosure include arrays comprising a plurality of different engineered transaminase polypeptides at different addressable position, wherein the different polypeptides are different variants of a reference sequence each having at least one different improved enzyme property. Such arrays comprising a plurality of engineered polypeptides and methods of their use are known (See e.g., WO2009/008908A2).

5.4 POLYNUCLEOTIDES, CONTROL SEQUENCES, EXPRESSION VECTORS, AND HOST CELLS USEFUL FOR PREPARING ENGINEERED TRANSAMINASE POLYPEPTIDES

In another aspect, the present disclosure provides polynucleotides encoding the engineered polypeptides having transaminase activity described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered transaminase can be introduced into appropriate host cells to express the corresponding engineered transaminase polypeptide.

As will be apparent to the skilled artisan, availability of a protein sequence and the knowledge of the codons corresponding to the various amino acids provide a description of all the polynucleotides capable of encoding the subject protein sequence. The degeneracy of the genetic code, where the same amino acids are encoded by alternative or synonymous codons allows an extremely large number of nucleic acids to be made, all of which encode the improved transaminase enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein, including the amino acid sequences of the exemplary engineered polypeptides provided in Tables 2A, 2B, and 2C, and disclosed in the sequence listing incorporated by reference herein as the sequences of the even-numbered sequence identifiers of SEQ ID NO:4-306. As described herein, in some embodiments, excluded from the embodiments of the polynucleotides are sequences encoding one or more of amino acid sequences selected from SEQ ID NO:4, 40, 62, 64, 70, 78, 122, 130, 160, 178, and 192.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the transaminases since the natural sequence will comprise preferred codons and because use of preferred codons may not be required for all amino acid residues. Consequently, codon optimized polynucleotides encoding the transaminase enzymes may contain preferred codons at about 40%, 50%, 60%, 70%, 80%, or greater than 90% of codon positions of the full length coding region.

In some embodiments, the polynucleotide encodes a transaminase polypeptide comprising an amino acid sequence that is at least about 80%, 85%, 86%, 87%, 88%, 89%, 90%, 91%, 92%, 93%, 94%, 95%, 96%, 97%. 98%, 99%, or more identical to a reference sequence selected from the even-numbered sequence identifiers of SEQ ID NO:4-306, where the polypeptide has transaminase activity and one or more of the improved properties as described herein, for example the ability to convert compound (2) to product compound (1) with increased activity compared to the polypeptide of SEQ ID NO:2. In some embodiments, the reference sequence is selected from SEQ ID NO:4, 40, 62, 64, 70, 78, 122, 130, 160, 178, and 192. In some embodiments, the reference sequence is SEQ ID NO:4. In some embodiments, the reference sequence is SEQ ID NO:40. In some embodiments, the reference sequence is SEQ ID NO:62. In some embodiments, the reference sequence is SEQ ID NO:64. In some embodiments, the reference sequence is SEQ ID NO:70. In some embodiments, the reference sequence is SEQ ID NO:78. In some embodiments, the reference sequence is SEQ ID NO: 122. In some embodiments, the reference sequence is SEQ ID NO: 130. In some embodiments, the reference sequence is SEQ ID NO: 160. In some embodiments, the reference sequence is SEQ ID NO: 178. In some embodiments, the reference sequence is SEQ ID NO: 192.

In some embodiments, the polynucleotide encodes an engineered transaminase polypeptide comprising an amino acid sequence that has the percent identity described above and (a) has one or more amino acid residue differences as compared to SEQ ID NO:2 selected from In some embodiments, the present disclosure provides an engineered polypeptide having transaminase activity comprising an amino acid sequence having at least 80% sequence identity to reference sequence of SEQ ID NO:2 and (a) an amino acid residue difference as compared to SEQ ID NO:2 selected from X33L, X36C, X41C/F/K/M/N/R, X42G, X48D/E/G/K/T, X51K, X54P, X76S, X122F/Q, X148Q, X152T, X155A/I/K/T/V, X156R, X160P, X215G/H/L, X241R, X270T, X273H, X325M; and X241R, and/or (b) a combination of residue differences selected from; X42G, X54P, X152S, and X155T; X42G, X54P, X152S, X155T, and R164P; X42G, X54P, X150F, X152S, and X155T; X42G, X54P, X150F, X152S, X155T, and X267V; X42G, X54P, X150F, X152S, X155L, W156Q, and C215G; X42G, X54P, X150F, X152S, X155T, X215G, and X267V; X33L; X42G, X54P, X117G; X150F, X152S, X155I, X156Q, and C215G; and X41K, X42G, X54P, X150F, X152S, X155K, X156Q, and C215G; X33L, X42G, X54P, X109S, X150F, X152S, X155K, X156Q, and X215H; X33L, X42G, X54P, X150F, X152S, X155I, X156Q, and X215G; X33L, X42G, X54P, X150F, X152S, X155K, X156Q, and X215H; X33L, X42G, X54P, X150F, X152S, X155L, X156Q, and X215H; X33L, X42G, X54P, X150F, X152S, X155L, X156Q, X215H, and X241R; X41F, X42G, X54P, X122Q, X150F, X152T, X155V, X156Q, and X215G; X41F, X42G, X54P, X150F, X152S, X155L, X156Q, X171I, X215G, and X241R; X41F, X42G, X54P, X150F, X152S, X155I, X156Q, V171I, and X215G; X41F, X42G, X54P, X150F, X152S, X155I, X156Q, and X215G; X41F, X42G, X54P, X150F, X152S, X155L, X156Q, X171I, and X215G; X41F, X42G, X54P, X150F, X152S, X155L, X156Q, and X215G; X42G, X48G, X54P, X150F, X152S, X155L, X156Q, and X215H; X42G, X54P, X60V, X150F, X152S, X155L, X156Q, and X215G; X42G, X54P, X68A, X150F, X152S, X155L, X156Q, and X215G; X42G, X54P, X69S, X150F, X152S, X155L, X156Q, and X215G; X42G, X54P, X122Q, X150F, X152S, X155I, X156Q, X215G, and X241R; X42G, X54P, X122Q, X150F, X152S, X155L, X156Q, X171I, X215G, and X241R; X42G, X54P, X122Q, X150F, X152T, X155V, X156Q, X171I, X215G, and X241R; X42G, X54P, X126M, X150F, X152S, X155L, X156Q, and X215G; X42G, X54P, X135I, X136Y, X150F, X152S, X155L, X156Q, X192F, and X215G; X42G, X54P, X136I, X150F, X152S, X155L, X156Q, and X215G; X42G, X54P, X136I, X150F, X152S, X155L, X156Q, X215G, and X224I; X42G, X54P, X136I, X150F, X152S, X155L, X156Y, X215G, X282V, and X284I; X42G, X54P, X136I, X150F, X152S, X155L, X156Y, X215G, and X284P; X42G, X54P, X136Y, X150F, X152S, X155L, X156Q, X215G, X282V, and X284P; X42G, X54P, X150F, X152S, X155I, X156Q, X171I, X215G, and X241R; X42G, X54P, X150F, X152S, X155L, X156Q, X193M, and X215G; X42G, X54P, X150F, X152S, X155L, X156Q, X215G, X282V, and X284I; X42G, X54P, X150F, X152S, X155L, X156Q, X215G, and X283S; X42G, X54P, X150F, X152S, X155L, X156Q, X215G, and X284I; and X42G, X54P, X150F, X152S, X155L, X156Y, and X215G.

In some embodiments, the polynucleotide encodes an engineered transaminase polypeptide comprising an amino acid sequence that has the percent identity described above and one or more residue differences as compared to SEQ ID NO:2 selected from: X5K, X33L, X36C, X41C/F/K/M/N/R, X42A/G, X44Q, X48D/E/G/K/T, X49T, X51K, X54P, X55L, X76S, X108V, X117G, X122F/Q, X126A, X148Q, X150A/F, X152S/T, X155A/I/K/I/T/V, X156Q/R/S, X160P, X164P, X165N, X182T, X215G/H/L, X218M, X241R, X267V, X270T, X273H, X325M, and X328I.

In some embodiments, the polynucleotide encoding the engineered transaminase polypeptide comprises a sequence selected from the odd-numbered sequence identifiers of SEQ ID NO:3-305. In some embodiments, the polynucleotide sequences are selected from SEQ ID NO:3, 39, 61, 63, 69, 77, 121, 129, 159, 177, and 191.

In some embodiments, the present disclosure provides a polynucleotide that hybridizes under defined conditions, such as moderately stringent or highly stringent conditions, to a polynucleotide sequence (or complement thereof) encoding an engineered transaminase of the present disclosure. In some embodiments, the polynucleotides are capable of hybridizing under highly stringent conditions to a polynucleotide selected from the sequences having the odd-numbered sequence identifiers of SEQ ID NO:3-305, or a complement thereof, and encodes a polypeptide having transaminase activity with one or more of the improved properties described herein. In some embodiments, the polynucleotide capable of hybridizing under highly stringent conditions encodes an engineered transaminase polypeptide comprising an amino acid sequence that has (a) has one or more amino acid residue differences as compared to SEQ ID NO:2 selected from In some embodiments, the present disclosure provides an engineered polypeptide having transaminase activity comprising an amino acid sequence having at least 80% sequence identity to reference sequence of SEQ ID NO:2 and (a) an amino acid residue difference as compared to SEQ ID NO:2 selected from X33L, X36C, X41C/F/K/M/N/R, X42G, X48D/E/G/K/T, X51K, X54P, X76S, X122F/Q, X148Q, X152T, X155A/I/K/T/V, X156R, X160P, X215G/H/L, X241R, X270T, X273H, X325M; and X241R, and/or (b) a combination of residue differences selected from: X42G, X54P, X152S, and X155T; X42G, X54P, X152S, X155T, and R164P; X42G, X54P, X150F, X152S, and X155T; X42G, X54P, X150F, X152S, X155T, and X267V; X42G, X54P, X150F, X152S, X155L, W156Q, and C215G; X42G, X54P, X150F, X152S, X155T, X215G, and X267V; X33L; X42G, X54P, X117G; X150F, X152S, X155I, X156Q, and C215G; and X41K, X42G, X54P, X150F, X152S, X155K, X156Q, and C215G; X33L, X42G, X54P, X109S, X150F, X152S, X155K, X156Q, and X215H; X33L, X42G, X54P, X150F, X152S, X155I, X156Q, and X215G; X33L, X42G, X54P, X150F, X152S, X155K, X156Q, and X215H; X33L, X42G, X54P, X150F, X152S, X155L, X156Q, and X215H; X33L, X42G, X54P, X150F, X152S, X155L, X156Q, X215H, and X241R; X41F, X42G, X54P, X122Q, X150F, X152T, X155V, X156Q, and X215G; X41F, X42G, X54P, X150F, X152S, X155L, X156Q, X171I, X215G, and X241R; X41F, X42G, X54P, X150F, X152S, X155I, X156Q, V171I, and X215G; X41F, X42G, X54P, X150F, X152S, X155I, X156Q, and X215G; X41F, X42G, X54P, X150F, X152S, X155L, X156Q, X171I, and X215G; X41F, X42G, X54P, X150F, X152S, X155L, X156Q, and X215G; X42G, X48G, X54P, X150F, X152S, X155L, X156Q, and X215H; X42G, X54P, X60V, X150F, X152S, X155L, X156Q, and X215G; X42G, X54P, X68A, X150F, X152S, X155L, X156Q, and X215G; X42G, X54P, X69S, X150F, X152S, X155L, X156Q, and X215G; X42G, X54P, X122Q, X150F, X152S, X155I, X156Q, X215G, and X241R; X42G, X54P, X122Q, X150F, X152S, X155L, X156Q, X171I, X215G, and X241R; X42G, X54P, X122Q, X150F, X152T, X155V, X156Q, X171I, X215G, and X241R; X42G, X54P, X126M, X150F, X152S, X155L, X156Q, and X215G; X42G, X54P, X135I, X136Y, X150F, X152S, X155L, X156Q, X192F, and X215G; X42G, X54P, X136I, X150F, X152S, X155L, X156Q, and X215G; X42G, X54P, X136I, X150F, X152S, X155L, X156Q, X215G, and X224I; X42G, X54P, X136I, X150F, X152S, X155L, X156Y, X215G, X282V, and X284I; X42G, X54P, X136I, X150F, X152S, X155L, X156Y, X215G, and X284P; X42G, X54P, X136Y, X150F, X152S, X155L, X156Q, X215G, X282V, and X284P; X42G, X54P, X150F, X152S, X155I, X156Q, X171I, X215G, and X241R; X42G, X54P, X150F, X152S, X155L, X156Q, X193M, and X215G; X42G, X54P, X150F, X152S, X155L, X156Q, X215G, X282V, and X284I; X42G, X54P, X150F, X152S, X155L, X156Q, X215G, and X283S; X42G, X54P, X150F, X152S, X155L, X156Q, X215G, and X284I; and X42G, X54P, X150F, X152S, X155L, X156Y, and X215G, In some embodiments, the polynucleotide capable of hybridizing under highly stringent conditions encodes a transaminase polypeptide that has the percent identity described above and one or more residue differences as compared to SEQ ID NO:2 selected from: X5K, X33L, X36C, X41C/F/K/M/N/R, X42A/G, X44Q, X48D/E/G/K/T, X49T, X51K, X54P, X55L, X76S, X108V, X117G, X122F/Q, X126A, X148Q, X150A/F, X152S/T, X155A/I/K/L/TV, X156Q/R/S, X160P, X164P, X165N, X182T, X215G/H/L, X218M, X241R, X267V, X270T, X273H, X325M, and X328I.

In some embodiments, the polynucleotides encode the polypeptides described herein but have about 50%, 55%, 60%, 65%. 70%, 75%, 80%. 85%, 86%, 87%. 88%, 89%, 90%. 91%, 92%, 93%, 94%, 95%, 96%, 97%, 98%, or 99% or more sequence identity at the nucleotide level to a reference polynucleotide encoding the engineered transaminase polypeptide. In some embodiments, the reference polynucleotide sequence is selected from the sequences having the odd-numbered sequence identifiers of SEQ ID NO:3-305.

An isolated polynucleotide encoding an engineered transaminase polypeptide may be manipulated in a variety of ways to provide for expression of the polypeptide, including further sequence alteration by codon-optimization to improve expression, insertion in a suitable expression with or without further control sequences, and transformation into a host cell suitable for expression and production of the polypeptide.

Manipulation of the isolated polynucleotide prior to its insertion into a vector may be desirable or necessary depending on the expression vector. The techniques for modifying polynucleotides and nucleic acid sequences utilizing recombinant DNA methods are well known in the art. Guidance is provided in Sambrook et al., 2001. Molecular Cloning: A Laboratory Manual, 3$^{rd}$ Ed., Cold Spring Harbor Laboratory Press, and Current Protocols in Molecular Biology, Ausubel. F, ed., Greene Pub. Associates, 1998, updates to 2010.

The polynucleotides disclosed herein can further comprise a promoter sequence depending on the particular cellular production system used. For bacterial host cells, suitable promoters for directing transcription of the nucleic acid constructs of the present disclosure, include, among others, the promoters obtained from the E. coli lac operon, Streptomyces coelicolor agarase gene (dagA), Bacillus subtilis levansucrase gene (sacB), Bacillus licheniformis alpha-amylase gene (amyL), Bacillus stearothermophilus maltogenic amylase gene (amyM), Bacillus amyloliquefaciens alpha-amylase gene (amyQ). Bacillus licheniformis penicillinase gene (penP), Bacillus subtilis xylA and xylB genes, and prokaryotic beta-lactamase gene (Villa-Kamaroff et al., 1978, Proc. Natl Acad. Sci. USA 75: 3727-3731), and the tac promoter (DeBoer et al., 1983, Proc. Natl Acad. Sci. USA 80: 21-25). For filamentous fungal host cells, suitable promoters for directing the transcription of the nucleic acid constructs of the present disclosure include promoters obtained from the genes for Aspergillus orzae TAKA amylase, Rhizomucor miehei aspartic proteinase, Aspergillus niger neutral alpha-amylase, Aspergillus niger acid stable alpha-amylase, Aspergillus niger or Aspergillus awamori glucoamylase (glaA), Rhizomucor miehei lipase, Aspergillus oryzae alkaline protease, Aspergillus oryzae triose phosphate isomerase. Aspergillus nidulans acetamidase, and Fusarium oxysporum trypsin-like protease (WO 96/00787), as well as the NA2-tpi promoter (a hybrid of the promoters from the genes for Aspergillus niger neutral alpha-amylase and Aspergillus oryzae triose phosphate isomerase), and mutant, truncated, and hybrid promoters thereof. In a yeast host, useful promoters can be from the genes for Saccharomyces cerevisiae enolase (ENO-1), Saccharomyces cerevisiae galactokinase (GAL 1), Saccharomyces cerevisiae alcohol dehydrogenase-glyceraldehyde-3-phosphate dehydrogenase (ADH2/GAP), and Saccharomyces cerevisiae 3-phosphoglycerate kinase. Other useful promoters for yeast host cells are described by Romanos et al., 1992, Yeast 8:423-488.

The control sequence may also be a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice may be used in the present disclosure. For example, exemplary transcription terminators for filamentous fungal host cells can be obtained from the genes for Aspergillus oryzae TAKA amylase, Aspergillus niger glucoamylase, Aspergillus nidulans anthranilate synthase, Aspergillus niger alpha-glucosidase, and Fusarium oxysporum trypsin-like protease. Exemplary terminators for yeast host cells can be obtained from the genes for Saccharomyces cerevisiae enolase, Saccharomyces cerevisiae cytochrome C (CYC1), and Saccharomyces cerevisiae glyceraldehyde-3-phosphate dehydrogenase. Other useful terminators for yeast host cells are described by Romanos et al., 1992, supra.

The control sequence may also be a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary bacterial leader sequences can use the pelB leader sequence (Lei et al., 1987. J Bacteriol. 169(9):4379-4383) and leader sequences of dsbA, dsbC. Bce, CupA2, CupB2 of Pseudomonas fluorescens (U.S. Pat. No. 7,618, 799). Exemplary leader sequences for filamentous fungal host cells are obtained from the genes for Aspergillus oryzae TAKA amylase and Aspergillus nidulans triose phosphate isomerase. Suitable leaders for yeast host cells are obtained from the genes for Saccharomyces cerevisiae enolase (ENO-1), Saccharomyces cerevisiae 3-phosphoglycerate kinase, Saccharomyces cerevisiae alpha-factor, and Saccharomyces cerevisiae alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present disclosure. Exemplary polyadenylation sequences for filamentous fungal host cells can be from the genes for Aspergillus oryzae TAKA amylase, Aspergillus niger glucoamylase, Aspergillus nidulans anthranilate synthase, Fusarium oxysporum trypsin-like protease, and Aspergillus niger alpha-glucosidase. Useful polyadenylation sequences for yeast host cells are described by Guo and Sherman, 1995, Mol Cell Bio 15:5983-5990. Exemplary mammalian polyadenylation sequences can be found in Zhang et al., 2005, Nucleic Acids Res. 33:D116-D120.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used. Effective signal peptide coding regions for bacterial host cells are the signal peptide coding regions obtained from the genes for Bacillus NCIB 11837 maltogenic amylase. Bacillus stearothermophilus alpha-amylase, Bacillus licheniformis subtilisin, Bacillus licheniformis beta-lactamase, Bacillus stearothermophilus neutral proteases (nprT, nprS, nprM), and Bacillus subtilis prsA. Further signal peptides are described by Simonen and Palva, 1993, Microbiol Rev 57: 109-137. Effective signal peptide coding regions for filamentous fungal host cells can be the signal peptide coding regions obtained from the genes for Aspergillus orzae TAKA amylase, Aspergillus niger neutral amylase, Aspergillus niger glucoamylase, Rhizomucor miehei aspartic proteinase, Humicola insolens cellulase, and Humicola lanuginosa lipase. Useful signal peptides for yeast host cells can be from the genes for Saccharomyces cerevisiae alpha-factor and Saccharomyces cerevisiae invertase. Other useful signal peptide coding regions are described by Romanos et al., 1992, supra.

The control sequence may also be a propeptide coding region that codes for an amino acid sequence positioned at the amino terminus of a polypeptide. The resultant polypeptide is known as a pro-enzyme or pro-polypeptide (or a zymogen in some cases). A pro-polypeptide can be converted to a mature active polypeptide by catalytic or autocatalytic cleavage of the pro-peptide from the pro-polypeptide. The pro-peptide coding region may be obtained from the genes for Bacillus subtilis alkaline protease (aprE), Bacillus subtilis neutral protease (nprT), Saccharomyces cerevisiae alpha-factor, Rhizomucor miehei aspartic proteinase, and Myceliophthora thermophila lactase (WO 95/33836). Where both signal peptide and propeptide regions are present at the amino terminus of a polypeptide, the pro-peptide region is positioned next to the amino terminus of a polypeptide and the signal peptide region is positioned next to the amino terminus of the pro-peptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include, as examples, the ADH2 system or GAL 1 system. In filamentous fungi, suitable regulatory sequences include the TAKA alpha-amylase promoter, Aspergillus niger glucoamylase promoter, and Aspergillus oryzae glucoamylase promoter. Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the polypeptide of the present disclosure would be operably linked with the regulatory sequence.

In another aspect, the present disclosure is also directed to a recombinant expression vector comprising a polynucleotide encoding an engineered transaminase polypeptide or a variant thereof, and one or more expression regulating regions such as a promoter and a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present disclosure may be expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids. The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector of the present disclosure can include one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from Bacillus subtilis or Bacillus licheniformis, or markers which confer antibiotic resistance such as ampicillin, kanamycin, chloramphenicol, or tetracycline resistance. Suitable markers for yeast host cells are ADE2, HIS3. LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an Aspergillus cell include the amdS and pyrG genes of Aspergillus nidulans or Aspergillus oryzae and the bar gene of Streptomyces hygroscopicus.

The expression vectors of the present disclosure also can include an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or non-homologous recombination.

Alternatively, the expression vector may contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements should preferably contain a sufficient number of nucleic acids, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori or the origins of replication of plasmids pBR322, pUC19, pACYC177 (which plasmid has the P5A ori), or pACYC184 permitting replication in *E. coli*, and pUB110, pE194, pTA1060, or pAMβ1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it function in a temperature-sensitive manner in the host cell (see, e.g., Ehrlich, 1978, Proc Natl Acad Sci. USA 75:1433).

More than one copy of a nucleic acid sequence of the present disclosure may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many expression vectors useful with the embodiments of the present disclosure are commercially available. Suitable commercial expression vectors include p3×FLAGTM™ expression vectors from Sigma-Aldrich Chemicals, which includes a CMV promoter and hGH polyadenylation site for expression in mammalian host cells and a pBR322 origin of replication and ampicillin resistance markers for amplification in *E. coli*. Other suitable expression vectors are pBluescriptII SK(-) and pBK-CMV, which are commercially available from Stratagene, LaJolla Calif., and plasmids which are derived from pBR322 (Gibco BRL), pUC (Gibco BRL), pREP4, pCEP4 (Invitrogen) or pPoly (Lathe et al., 1987, Gene 57:193-201).

An exemplary expression vector can be prepared by operatively linking a polynucleotide encoding an improved transaminase into the plasmid pCK1109001 which contains the lac promoter under control of the lacI repressor. The expression vector also contains the P15a origin of replication and the chloramphenicol resistance gene.

In another aspect, the present disclosure provides a host cell comprising a polynucleotide encoding an improved transaminase polypeptide of the present disclosure, the polynucleotide being operatively linked to one or more control sequences for expression of the transaminase enzyme in the host cell. Host cells for use in expressing the polypeptides encoded by the expression vectors of the present disclosure are well known in the art and include but are not limited to, bacterial cells, such as *E. coli*, *Arthrobacter* sp. KNK168, *Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. An exemplary host cell is *Escherichia coli* W3110 (ΔfhuA). Appropriate culture mediums and growth conditions for the above-described host cells are well known in the art.

Polynucleotides for expression of the transaminase may be introduced into cells by various methods known in the art. Techniques include among others, electroporation, biolistic particle bombardment, liposome mediated transfection, calcium chloride transfection, and protoplast fusion. Various methods for introducing polynucleotides into cells will be apparent to the skilled artisan.

5.6 METHODS OF GENERATING ENGINEERED TRANSAMINASE POLYPEPTIDES

In some embodiments, to make the improved engineered polynucleotides and engineered polypeptides of the present disclosure, the naturally-occurring transaminase enzyme that catalyzes the transamination reaction is obtained (or derived) from *Arthrobacter* sp. KNK168. In some embodiments, the parent polynucleotide sequence id codon optimized to enhance expression of the transaminase in a specified host cell. The parental polynucleotide sequence encoding the wild-type polypeptide of *Arthrobacter* sp. KNK168 has been described (See e.g., Iwasaki et al., Appl. Microbiol. Biotechnol., 2006, 69: 499-505). Preparations of engineered transaminases based on this parental sequence are also described in US patent publication no. 2010/0285541 A1 and published International application WO2010/099501.

The engineered transaminases can be obtained by subjecting the polynucleotide encoding the naturally occurring transaminase to mutagenesis and/or directed evolution methods, as discussed above. An exemplary directed evolution technique is mutagenesis and/or DNA shuffling as described in Stemmer, 1994, Proc Natl Acad Sci USA 91:10747-10751; WO 95/22625; WO 97/0078; WO 97/35966; WO 98/27230; WO 00/42651; WO 01/75767 and U.S. Pat. No. 6,537,746. Other directed evolution procedures that can be used include, among others, staggered extension process (StEP), in vitro recombination (Zhao et al., 1998, Nat. Biotechnol. 16:258-261), mutagenic PCR (Caldwell et al., 1994, PCR Methods Appl. 3:S136-S140), and cassette mutagenesis (Black et al., 1996, Proc Natl Acad Sci USA 93:3525-3529). Mutagenesis and directed evolution techniques useful for the purposes herein are also described in e.g., Ling, et al., 1997, Anal. Biochem. 254(2): 157-78; Dale et al., 1996, "Oligonucleotide-directed random mutagenesis using the phosphorothioate method," in Methods Mol. Biol. 57:369-74; Smith, 1985, Ann. Rev. Genet. 19:423-462; Botstein et al., 1985, Science 229:1193-1201; Carter, 1986, Biochem. J. 237:1-7; Kramer et al., 1984, Cell, 38:879-887; Wells et al., 1985, Gene 34:315-323; Minshull et al., 1999, Curr Opin Chem Biol 3:284-290; Christians et al., 1999, Nature Biotech 17:259-264; Crameri et al., 1998, Nature 391:288-291; Crameri et al., 1997, Nature Biotech 15:436-438; Zhang et al., 1997, Proc Natl Acad Sci USA 94:45-4-4509; Crameri et al., 1996. Nature Biotech 14:315-319; Stemmer, 1994, Nature 370:389-391; Stemmer, 1994, Proc Natl Acad Sci USA 91:10747-10751; PCT Publ. Nos. WO 95/22625, WO 97/0078, WO 97/35966, WO 98/27230, WO 00/42651, and WO 01/75767; and U.S. Pat. No. 6,537, 746. All publications and patent are hereby incorporated by reference herein.

The clones obtained following mutagenesis treatment can be screened for engineered transaminases having a desired improved enzyme property. Measuring enzyme activity from the expression libraries can be performed using the standard biochemistry techniques, such as HPLC analysis following OPA derivatization of the product amine.

Where the improved enzyme property desired is thermostability, enzyme activity may be measured after subjecting the enzyme preparations to a defined temperature and measuring the amount of enzyme activity remaining after heat treatments. Clones containing a polynucleotide encoding a transaminase are then isolated, sequenced to identify the nucleotide sequence changes (if any), and used to express the enzyme in a host cell.

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides of the disclosure can be prepared by chemical synthesis using, e.g., the classical phosphoramidite method described by Beaucage et al., 1981, Tet Lett 22:1859-69, or the method described by Matthes et al., 1984, EMBO J. 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources.

In some embodiments, the present disclosure also provides methods for preparing or manufacturing the engineered transamination polypeptides capable of converting compound (2) to compound (1) under suitable reaction conditions, wherein the methods comprise culturing a host cell capable of expressing a polynucleotide encoding the engineered polypeptide under culture conditions suitable for expression of the polypeptide. In some embodiments, the method for preparation of the polypeptide further comprises isolating the polypeptide. The engineered polypeptides can be expressed in appropriate cells (as described above), and isolated (or recovered) from the host cells and/or the culture medium using any one or more of the well known techniques used for protein purification, including, among others, lysozyme treatment, sonication, filtration, salting-out, ultracentrifugation, and chromatography. Chromatographic techniques for isolation of the polypeptide include, among others, reverse phase chromatography high performance liquid chromatography, ion exchange chromatography, gel electrophoresis, and affinity chromatography. Conditions for purifying a particular engineered polypeptide will depend, in part, on factors such as net charge, hydrophobicity, hydrophilicity, molecular weight, molecular shape, etc., and will be apparent to those having skill in the art.

5.7 METHODS OF USING THE ENGINEERED TRANSAMINASE ENZYMES AND COMPOUNDS PREPARED THEREWITH

In another aspect, the engineered transaminase polypeptides disclosed herein can be used in a process for the conversion of the substrate compound (2), or structural analogs thereof, to the product of compound (1) or the corresponding structural analog. Generally the structural analogs of compound (1) are encompassed within structural Formula (I) and structural Formula (Ia).

In some embodiments the engineered polypeptides disclosed herein can be used in a process for the preparation of chiral amine compounds. In some embodiments, the present disclosure provides a method for preparing a compound of structural Formula (I):

having the indicated stereochemical configuration at the stereogenic center marked with an *; in an enantiomeric excess of at least 70% over the opposite enantiomer, wherein Z is $OR^2$ or $NR^2R^3$;

$R^1$ is $C_{1-8}$ alkyl, aryl, heteroaryl, aryl-$C_{1-2}$ alkyl, heteroaryl-$C_{1-2}$ alkyl, or a 5- to 6-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl, wherein alkyl and alkoxy are unsubstituted or substituted with one to five fluorines;

$R^2$ and $R^3$ are each independently hydrogen. $C_{1-8}$ alkyl, aryl, or aryl-$C_{1-2}$ alkyl; or $R^2$ and $R^3$ together with the nitrogen atom to which they are attached form a 4- to 7-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl, wherein alkyl and alkoxy are unsubstituted or substituted with one to five fluorines; and the heterocyclic ring system being optionally fused with a 5- to 6-membered saturated or aromatic carbocyclic ring system or a 5- to 6-membered saturated or aromatic heterocyclic ring system containing one to two heteroatoms selected from O, S, and N, the fused ring system being unsubstituted or substituted with one to two substituents selected from hydroxy, amino, fluorine, $C_{1-4}$ alkyl. $C_{1-4}$ alkoxy, and trifluoromethyl; the process comprising the step of contacting a prochiral ketone substrate compound structural Formula (II):

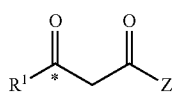
(II)

with an engineered polypeptide as disclosed herein in the presence of an amino group donor in a suitable organic solvent under suitable reaction conditions. In some embodiments of the process, $R^1$ is benzyl and the phenyl group of benzyl is unsubstituted or substituted one to three substituents selected from the group consisting of fluorine, trifluoromethyl, and trifluoromethoxy.

In some embodiments of the process for preparing a compound of Formula (I), Z is $NR^2R^3$, wherein $NR^2R^3$ is a heterocycle of the structural Formula (III):

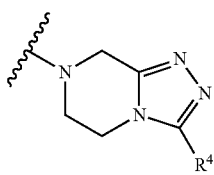
(III)

wherein $R^4$ is hydrogen or $C_{1-4}$ alkyl which is unsubstituted or substituted with one to five fluorines.

In some embodiments of the process for preparing a compound of structural Formula (I), the compound of Formula (II) specifically excludes compound (2) and the compound of Formula (I) prepared by the method specifically excludes compound (1).

In some embodiments, the engineered polypeptides having transaminase activity of the present disclosure can be used in a process for preparing a compound of structural Formula (Ia):

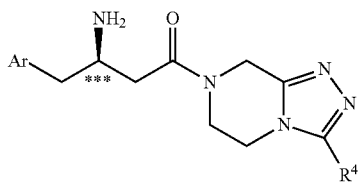
(Ia)

having the (R)-configuration at the stereogenic center marked with an ***; in an enantiomeric excess of at least 70% over the enantiomer having the opposite (S)-configuration; wherein Ar is phenyl which is unsubstituted or substituted with one to five substituents independently selected from the group consisting of fluorine, trifluoromethyl, and trifluoromethoxy; and $R^4$ is hydrogen or $C_{1-4}$ alkyl unsubstituted or substituted with one to five fluorines; the process comprising the step of:

contacting a prochiral ketone substrate compound of structural Formula (IIa):

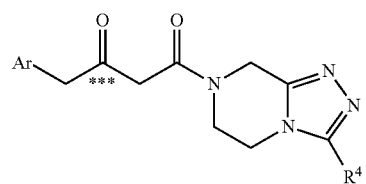
(IIa)

with an engineered polypeptide as disclosed herein in the presence of an amino group donor under suitable reaction conditions. In some embodiments of the process for preparing the compound of Formula (Ia). Ar is selected from 2,5-difluorophenyl or 2,4,5-trifluorophenyl, and $R^4$ is trifluoromethyl.

In some embodiments of the process for preparing a compound of structural Formula (Ia), the compound of Formula (IIa) specifically excludes compound (2) and the compound of Formula (Ia) prepared by the method specifically excludes compound (1).

In some embodiments, the present disclosure provides a process of preparing compound (1), sitagliptin,

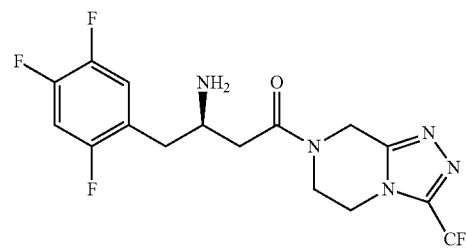
(1)

comprising a step of contacting a substrate of compound (2)

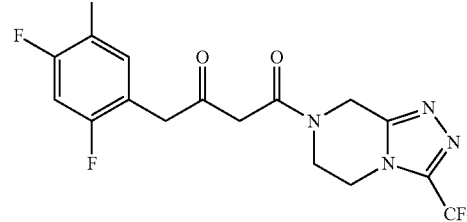
(2)

with an engineered polypeptide as disclosed herein in the presence of an amino group donor under suitable reaction conditions.

The present disclosure also contemplates that engineered transaminase polypeptides can be used for the preparation of other chiral amine compounds that are structural analogs of sitagliptin. Gemigliptin is an oral anti-hyperglycemic agent in the same class of dipeptidyl peptidase-4 (DPP-4) inhibitors as sitagliptin. Gemigliptin is a chiral amine compound having the structure of compound (3)

(3)

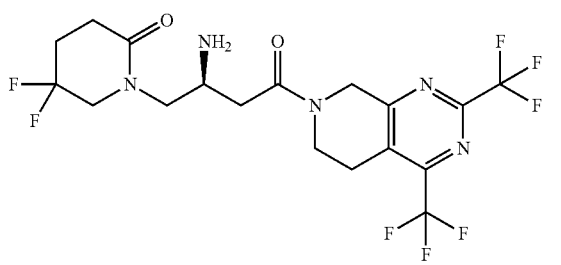

Gemigliptin has structure analogous to sitagliptin (compound (1)), and is within the same genus of structures of Formula (I). Accordingly, in one embodiment, the present disclosure provides a process of preparing compound (3), comprising a step of contacting a keto substrate of compound (4), or compound (4) modified with a protecting group, (4)

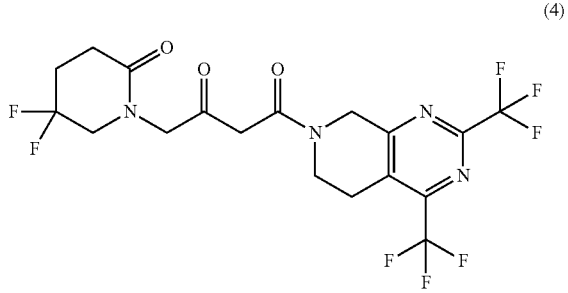 [SMILES: O=C(CC(=O)N1CCc2c(nc(C(F)(F)F)nc2C(F)(F)F)C1)CN1CC(F)(F)CCC1=O]

with an engineered polypeptide as disclosed herein in the presence of an amino group donor under suitable reaction conditions.

As described herein, and illustrated in the Examples, the present disclosure contemplates ranges of suitable reaction conditions that can be used in the processes herein, including but not limited to ranges of pH, temperature, buffer, solvent system, substrate loading, mixture of substrate compound stereoisomers, polypeptide loading, cofactor loading, pressure, and reaction time. Further suitable reaction conditions for carrying out the process for biocatalytic conversion of substrate compounds to product compounds using an engineered transaminase polypeptide described herein can be readily optimized by routine experimentation that includes, but is not limited to, contacting the engineered transaminase polypeptide and substrate compound under experimental reaction conditions of concentration, pH, temperature, solvent conditions, and detecting the product compound, for example, using the methods described in the Examples provided herein.

As described above, the engineered polypeptides having transaminase activity for use in the processes of the present disclosure generally comprise an amino acid sequence having at least 80%, 85%, 86%, 87%, 88%. 89%, 90%, 91%. 92%, 93%, 94%. 95%, 96%, 97%. 98%, or 99% identity to a reference amino acid sequence selected from any one of the even-numbered sequences of SEQ ID NO:2-306, and an engineered transaminase polypeptide comprising an amino acid sequence that has (a) has one or more amino acid residue differences as compared to SEQ ID NO:2 selected from X33L, X36C, X41C/M/R, X48K, X51K. X76S. X122F/Q, X148Q, X155K, X156R, X160P. X215G, X241R, X270T, X273H, and X325M; and/or (b) a combination of residue differences as compared to SEQ ID NO:2 selected from: (i) X42G, X54P, X152S, and X155T; (ii) X42G, X54P, X152S, X155T, and R164P; (iii) X42G, X54P, X150F, X152S, and X155T; (iv) X42G. X54P, X150F, X152S, X155T, and X267V; (v) X42G. X54P, X150F, X152S, X155L, W156Q, and C215G; (vi) X42G, X54P, X150F. X152S, X155T, X215G, and X267V; (vii) X33L; X42G, X54P, X117G; X150F, X152S, X155. X156Q, and C215G; and (viii) X41K, X42G, X54P, X150F, X152S, X155K, X156Q, and C215G. In some embodiments, the polynucleotide capable of hybridizing under highly stringent conditions encodes a transaminase polypeptide that has the percent identity described above and one or more residue differences as compared to SEQ ID NO:2 selected from: X5K, X33L, X36C, X41C/F/K/M/N/R, X42A/G, X44Q, X48D/E/G/K/T. X49T, X51K, X54P, X55L, X76S, X108V, X117G, X122F/Q, X126A, X148Q, X150A/F, X152S/T, X155A/I/K/L/T/V, X156Q/R/S, X160P, X164P, X165N, X182T. X215G/H/L, X218M, X241R, X267V, X270T. X273H, X325M, and X328I.

The improved activity, stability, and/or stereoselectivity of the engineered transaminase polypeptides disclosed herein in the conversion of compounds of Formula (II) to compounds of Formula (I), compounds of Formula (IIa) to compounds of Formula (Ia), compound (2) to compound (1), and/or compound (4) to compound (3), including various analogs thereof provides for processes wherein higher percentage conversion can be achieved with lower concentrations of the engineered polypeptide and also reduces the amount of residual protein that may need to be removed in subsequent steps for purification of product compound (e.g., compound (1)) and purification of compounds downstream of the product compound. In some embodiments of the process, the suitable reaction conditions comprise an engineered polypeptide concentration of about 0.1 to about 40 g/L, about 0.5 to about 20 g/L, about 1.0 to about 10 g/L, about 2 to about 5 g/L, about 40 g/L or less, about 20 g/L or less, about 15 g/L or less, about 10 g/L or less, about 5 g/L or less, about 3 g/L or less, about 2 g/L or less, about 1.5 g/L or less, about 1.0 g/L or less, about 0.75 g/L or less.

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments of the method, the suitable reaction conditions comprise a substrate compound loading of at least about 0.5 to about 200 g/L, 1 to about 200 g/L, 5 to about 150 g/L, about 10 to about 100 g/L, or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of compound (2), however it also contemplated that the equivalent molar amounts of various hydrates and salts of compound (2) also can be used in the process. In addition, substrate compounds covered by Formula (II), and (IIa), and compound (4) can also be used in appropriate amounts, in light of the amounts used for compound (2).

In the processes describes herein, the engineered transaminase polypeptide uses an amino donor to form the product compounds. In some embodiments, the amino donor in the reaction condition comprises a compound selected from isopropylamine (also referred to herein as "IPM"), putrescine, L-lysine, α-phenethylamine, D-alanine, L-alanine, or D,L-alanine, or D,L-ornithine. In some embodiments, the amino donor is selected from the group consisting of IPM, putrescine, L-lysine, D- or L-alanine. In some embodiments, the amino donor is IPM. In some embodiments, the suitable reaction conditions comprise the amino donor, in particular IPM, present at a concentration of at least about 0.1 to about 3.0 M, 0.2 to about 2.5 M, about 0.5 to about 2 M or about 1 to about 2 M. In some embodiments, the amino donor is present at a concentration of about 0.1, 0.2, 0.3, 0.4, 0.5, 0.6, 0.7, 0.8, 1, 1.5, 2, 2.5 or 3 M.

Suitable reaction conditions for the processes also typically comprise the presence of a cofactor in the reaction mixture. Because the engineered transaminases typically use members of the vitamin $B_6$ family, the reaction condition can comprise a cofactor selected from-pyridoxal-5'-phosphate (also known as pyridoxal-phosphate, PLP, P5P), pyridoxine (PN), pyridoxal (PL), pyridoxamine (PM), and their phosphorylated counterparts; pyridoxine phosphate (PNP), and pyridoxamine phosphate (PMP). In some embodiments, the suitable reaction conditions can comprise the presence of a cofactor selected from PLP, PN, PL, PM, PNP, and PMP, at a concentration of about 0.1 g/L to about 10 g/L, about 0.2 g/L to about 5 g/L, about 0.5 g/L to about 2.5 g/L. In some embodiments, the cofactor is PLP. Accordingly, in some embodiments, the suitable reaction conditions can comprise the presence of the cofactor, PLP, at a concentration of about 0.1 g/L to about 10 g/L, about 0.2 g/L to about 5 g/L, about 0.5 g/L to about 2.5 g/L. In some embodiments, the reaction conditions comprise a PLP concentration of about 10 g/L or less, about 5 g/L or less, about 2.5 g/L or less, about 1.0 g/L or less, about 0.5 g/L or less, or about 0.2 g/L or less.

In some embodiments of the process (e.g., where whole cells or lysates are used), the cofactor is present naturally in the cell extract and does not need to be supplemented. In some embodiments of the process (e.g., using partially purified, or purified transaminase enzyme), the process can further comprise a step of adding cofactor to the enzyme reaction mixture. In some embodiments, the cofactor is added either at the beginning of the reaction and/or additional cofactor is added during the reaction.

During the course of the transamination reactions, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, carbonate, phosphate, triethanolamine (TEA) buffer, and the like. In some embodiments, the buffer is TEA. In some embodiments of the process, the suitable reaction conditions comprise a buffer solution of TEA, where the TEA concentration is from about 0.01 to about 0.4 M, 0.05 to about 0.4 M, 0.1 to about 0.3 M, or about 0.1 to about 0.2 M. In some embodiments, the reaction condition comprises a TEA concentration of about 0.01, 0.02, 0.03, 0.04, 0.05, 0.07, 0.1, 0.12, 0.14, 0.16, 0.18, 0.2, 0.3, or 0.4 M. In some embodiments, the reaction conditions comprise water as a suitable solvent with no buffer present.

In the embodiments of the process, the reaction conditions can comprise a suitable pH. As noted above, the desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH of about 8 to about 12.5, a pH of about 8 to about 12, a pH of about 9.0 to about 11.5, or a pH of about 9.5 to about 11.0. In some embodiments, the reaction conditions comprise a solution pH of about 8, 8.5, 9, 9.5, 10, 10.5, 11, 11.5, 12 or 12.5.

In the embodiments of the processes herein, a suitable temperature can be used for the reaction conditions, for example, taking into consideration the increase in reaction rate at higher temperatures, the activity of the enzyme for sufficient duration of the reaction, and as further described below, increase rate of epimerization of the substrate diastereomers (for purposes of dynamic kinetic resolution). For example, the engineered polypeptides of the present disclosure have increased stability relative to naturally occurring transaminase polypeptide, and the engineered polypeptide of SEQ ID NO:2, which allow the engineered polypeptides of the present disclosure to be used at higher temperatures for increased conversion rates and improved substrate solubility characteristics for the reaction. Accordingly, in some embodiments, the suitable reaction conditions comprise a temperature of about 10° C. to about 70° C., about 10° C. to about 65° C. about 15° C. to about 60° C., about 20° C. to about 60° C., about 20° C. to about 55° C., about 30° C. to about 55° C., or about 40° C. to about 50° C. In some embodiments, the suitable reaction conditions comprise a temperature of about 10° C., 15° C., 20° C., 25° C., 30° C., 35° C., 40° C., 45° C., 50° C., 55° C., 60° C., 65° C., or 70° C. In some embodiments, the temperature during the enzymatic reaction can be maintained at a temperature throughout the course of the reaction. In some embodiments, the temperature during the enzymatic reaction can be adjusted over a temperature profile during the course of the reaction.

In some embodiments of the process, the suitable reaction conditions can further comprise the presence of the reduced cofactor, nicotinamide adenine dinucleotide (NADH), which can act to limit the inactivation of the transaminase enzyme (See e.g., van Ophem et al., 1998, Biochemistry 37(9):2879-88). In such embodiments where NADH is present, a cofactor regeneration system, such as glucose dehydrogenase (GDH) and glucose or formate dehydrogenase and formate can be used to regenerate the NADH in the reaction medium.

The processes using the engineered transaminases are generally carried out in a solvent. Suitable solvents include water, aqueous buffer solutions, organic solvents, and/or co-solvent systems, which generally comprise aqueous solvents and organic solvents. The aqueous solvent (water or aqueous co-solvent system) may be pH-buffered or unbuffered. In some embodiments, the processes using the engineered transaminase polypeptides are generally carried out in an aqueous co-solvent system comprising an organic solvent (e.g., ethanol, isopropanol (IPA), dimethyl sulfoxide (DMSO), ethyl acetate, butyl acetate, 1-octanol, heptane, octane, methyl t-butyl ether (MTBE), toluene, and the like), ionic liquids (e.g., 1-ethyl 4-methylimidazolium tetrafluoroborate, 1-butyl-3-methylimidazolium tetrafluoroborate, 1-butyl-3-methylimidazolium hexafluorophosphate, and the like). The organic solvent component of an aqueous co-solvent system may be miscible with the aqueous component, providing a single liquid phase, or may be partly miscible or immiscible with the aqueous component, providing two liquid phases. Exemplary aqueous co-solvent systems comprises water and one or more organic solvent. In general, an organic solvent component of an aqueous co-solvent system is selected such that it does not completely inactivate the transaminase enzyme. Appropriate co-solvent systems can be readily identified by measuring the enzymatic activity of the specified engineered transaminase enzyme with a defined substrate of interest in the candidate solvent system, utilizing an enzyme activity assay, such as those described herein. In some embodiments of the process, the suitable reaction conditions comprise an aqueous co-solvent comprising DMSO at a concentration of about 1% to about 80% (v/v), about 1 to about 70% (v/v), about 2% to about 60% (v/v), about 5% to about 40% (v/v), 10% to about 40% (v/v), 10% to about 30% (v/v), or about 10% to about 20% (v/v). In some embodiments of the process, the suitable reaction conditions comprise an aqueous co-solvent comprising DMSO at a concentration of at least about 1%, 5%, 10%, 15%, 20%, 25%, 30%, 35%, 40%, 45%, 50%, 55%, 60%, 65%, 70%, 75%, or 80% (v/v).

The suitable reaction conditions can comprise a combination of reaction parameters that provide for the biocatalytic conversion of the substrate compounds to its corresponding product compounds. Accordingly, in some embodiments of the process, the combination of reaction parameters comprises: (a) substrate loading of about 10 to 200 g/L of substrate compound (e.g. compound (2)); (b) engineered polypeptide concentration of about 0.5 g/L to 5 g/L; (c) IPM concentration of about 0.1 to 3 M; (d) PLP cofactor concentration of about 0.1 to 1 mM; (e) DMSO concentration of about 30% (v/v) to about 60% (v/v); (f) pH of about 9.5 to 11.5; and (g) temperature of about 45° C. to 60° C.

In some embodiments, the combination of reaction parameters comprises: (a) about 50 g/L of substrate compound (e.g. compound (2)); (b) about 2 g/L engineered polypeptide; (c) about 50% (v/v) dimethylsulfoxide (DMSO); (d) about 1 M isopropylamine (IPM); (e) about 1 mM pyridoxal phosphate (PLP); (f) about pH 10; and (g) about 50° C.

In some embodiments, the combination of reaction parameters comprises: (a) about 50 g/L of substrate compound (e.g. compound (2)); (b) about 1 g/L engineered polypeptide; (c) about 50% (v/v) dimethylsulfoxide (DMSO); (d) about 1 M isopropylamine (IPM); (e) about 1 mM pyridoxal phosphate (PLP); (f) about pH 11: and (g) about 55° C.

In some embodiments, the combination of reaction parameters comprises: (a) about 50 g/L of substrate compound (e.g. compound (2)); (b) about 0.5 g/L engineered polypeptide; (c) about 50% (v/v) dimethylsulfoxide (DMSO); (d) about 2 M isopropylamine (IPM); (e) about 1 mM pyridoxal phosphate (PLP); (f) about pH 11.5; and (g) about 55° C.

Further exemplary reaction conditions include the assay conditions provided in Tables 2A, 2B, and 2C, and Example 1.

In carrying out the transamination reactions described herein, the engineered transaminase polypeptide may be added to the reaction mixture in the partially purified or purified enzyme, whole cells transformed with gene(s) encoding the enzyme, and/or as cell extracts and/or lysates of such cells. Whole cells transformed with gene(s) encoding the engineered transaminase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (e.g., ammonium sulfate, polyethyleneimine, heat treatment or the like), followed by a desalting procedure (e.g., ultrafiltration, dialysis, and the like) prior to lyophilization. Any of the enzyme preparations may be stabilized by crosslinking using known crosslinking agents, such as, for example, glutaraldehyde, or immobilized to a solid phase material (e.g., resins, beads such as chitosan, Eupergit C, SEPABEADs, and the like).

In some embodiments of the transamination reactions described herein, the reaction is carried out under the suitable reaction conditions described herein, wherein the engineered transaminase polypeptide is immobilized to a solid support. Solid supports useful for immobilizing the engineered transaminases for carrying out the transamination reactions include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments where the engineered polypeptide can be expressed in the form of a secreted polypeptide, the culture medium containing the secreted polypeptides can be used in the process herein.

In some embodiments, solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, transaminase, and transaminase substrate may be added first to the solvent. For improved mixing efficiency when an aqueous co-solvent system is used, the transaminase, and cofactor may be added and mixed into the aqueous phase first. The organic phase may then be added and mixed in, followed by addition of the transaminase substrate. Alternatively, the transaminase substrate may be premixed in the organic phase, prior to addition to the aqueous phase.

In some embodiments, the process can further comprise a step of removal of the carbonyl by-product formed from the amino group donor when the amino group is transferred to the substrate compound of Formula (II), (IIa), compound (2), or compound (4). Such removal in situ can reduce the rate of the reverse reaction such that the forward reaction dominates and more substrate is then converted to product. Removal of the carbonyl by-product can be carried out in a number of ways. Where the amino group donor is an amino acid, such as alanine, the carbonyl by-product, a keto acid, can be removed by reaction with a peroxide (see, e.g., US Patent Publication 2008/0213845A1, incorporated herein by reference). Peroxides which can be used include, among others, hydrogen peroxide; peroxyacids (peracids) such as peracetic acid ($CH_3CO_1H$), trifluoroperacetic acid and metachloroperoxybenzoic acid; organic peroxides such as t-butyl peroxide (($CH_3$)$_3$COOH), or other selective oxidants such as tetrapropylammonium perruthenate, $MnO_2$, $KMnO_4$, ruthenium tetroxide and related compounds. Alternatively, pyruvate removal can be achieved via its reduction to lactate by employing lactate dehydrogenase to shift equilibrium to the product amine (see, e.g., Koszelewski et al., 2008, Adv Syn Catal. 350: 2761-2766). Pyruvate removal can also be achieved via its decarboxylation to carbon dioxide acetaldehyde by employing pyruvate decarboxylase (see, e.g., Hohne et al., 2008. Chem BioChem. 9: 363-365).

In some embodiments, where the choice of the amino donor results in a carbonyl by-product that has a vapor pressure higher than water (e.g., a low boiling co-product such as a volatile organic carbonyl compound), the carbonyl by-product can be removed by sparging the reaction solution with a non-reactive gas or by applying a vacuum to lower the reaction pressure and removing the carbonyl by-product present in the gas phase. A non-reactive gas is any gas that does not react with the reaction components. Various non-reactive gases include nitrogen and noble gases (e.g., inert gases). In some embodiments, the non-reactive gas is nitrogen gas. In some embodiments, the amino donor used in the process is isopropylamine (IPM), which forms the carbonyl by-product acetone upon transfer of the amino group to the amino group acceptor. The acetone can be removed by sparging with nitrogen gas or applying a vacuum to the reaction solution and removing the acetone from the gas phase by an acetone trap, such as a condenser or other cold trap. Alternatively, the acetone can be removed by reduction to isopropanol using a ketoreductase.

In some embodiments of the process where the carbonyl by-product is removed, the corresponding amino group donor can be added during the transamination reaction to replenish the amino group donor and/or maintain the pH of the reaction. Replenishing the amino group donor also shifts the equilibrium towards product formation, thereby increasing the conversion of substrate to product. Thus, in some embodiments where the amino group donor is IPM and the acetone product is removed in situ, the process can further comprise a step of adding IPM to the reaction solution to replenish the amino group donor lost during the acetone removal and to maintain the pH of the reaction (e.g., at about 8.5 to about pH 11.5).

In some embodiments, it is also contemplated that the process comprising the biocatalytic conversion of amine acceptor substrate compounds to chiral amine product compounds using transaminase polypeptides of the present disclosure can further comprise steps of formation of pharmaceutically acceptable salts or acids, pharmaceutically acceptable formulations, product work-up, extraction, isolation, purification, and/or crystallization, each of which can be carried out under a range of conditions.

In some embodiments, the processes using the engineered polypeptides disclosed herein can be carried out wherein the process further comprises the step of isolating the compound of Formula (I), the compound of Formula (Ia), the compound (1), or the compound (3) from the reaction.

In some embodiments, the processes using the engineered polypeptides disclosed herein can be carried out wherein the process further comprises the step of converting the compound of Formula (I), compound of Formula (Ia), the compound (1) or the compound (3) into a pharmaceutically acceptable salt by contacting said compound with a pharmaceutically acceptable acid in a suitable reaction solvent. In some embodiments of the process, the pharmaceutically acceptable acid is phosphoric acid and the pharmaceutically acceptable salt is the dihydrogen phosphate salt. In some embodiments, the processes can further comprise the step of crystallizing the pharmaceutically acceptable salt from the reaction solvent.

In some embodiments, the processes using the engineered polypeptides disclosed herein can be carried out wherein the amino group donor is selected from isopropylamine, alanine, 3-aminobutyric acid, or methylbenzylamine. In some embodiments, the amino group donor is isopropylamine.

As noted above, the compound (1) is sitagliptin, the active pharmaceutical ingredient in JANUVIA®. Accordingly, the processes disclosed herein using engineered polypeptides for making compound (1), and/or its pharmaceutically acceptable acid or salt, can be used in larger processes for the production of JANUVIA® or related pharmaceutical compounds. In some embodiments the present disclosure also provides a process for the preparation of (2R)-4-oxo-4-[3-(trifluoromethyl)-5,6-dihydro[1,2,4]triazolo[4,3-a]pyrazin-7(8H)-yl]-1-(2,4,5-trifluorophenyl)butan-2-amine phosphate (1:1) monohydrate, wherein the process comprises a step of converting a substrate compound (2) to a product compound (1) by contacting a substrate of compound (2) with an engineered polypeptide as disclosed herein in the presence of an amino group donor under suitable reaction conditions.

In some embodiments, the present disclosure further provides a process for the preparation of compound (3), or a pharmaceutically acceptable salt or acid of compound (3), wherein the process comprises a step of converting a substrate compound (4), or a substrate of compound (4) modified with a protecting group, to a product compound (3), by contacting a substrate of compound (4), or a substrate of compound (4) modified with a protecting group, with an engineered polypeptide as disclosed herein in the presence of an amino group donor under suitable reaction conditions.

Methods, techniques, and protocols for extracting, isolating, forming a salt of, purifying, and/or crystallizing aminated product compounds or cyclized compounds from biocatalytic reaction mixtures produced by the above disclosed processes are known to the ordinary artisan and/or accessed through routine experimentation. Additionally, illustrative methods are provided in the Examples below.

Various features and embodiments of the disclosure are illustrated in the following representative examples, which are intended to be illustrative, and not limiting.

6. EXAMPLES

Example 1

Synthesis, Optimization, and Screening of Engineered Polypeptides

A. Gene Acquisition and Optimization

A codon-optimized and engineered transaminase gene (SEQ ID NO:1) encoding the reference engineered polypeptide of SEQ ID NO:2 was used as the starting backbone for directed evolution to generate the genes encoding the engineered polypeptides having transaminase activity of the even-numbered sequence identifiers of SEQ ID NO:4-306, each of which is capable of converting the substrate compound (2) to the product compound (1) with improved enzyme properties relative to it and/or the reference polypeptide of SEQ ID NO:2. The gene of SEQ ID NO:1 and polypeptide of SEQ ID NO:2 of the present disclosure correspond to SEQ ID NO:109 and 110 of U.S. Pat. No. 8,293,507 B2, issued Oct. 23, 2012. The engineered transaminase polypeptide of SEQ ID NO:2 has the following 28 amino acid differences relative to the wild-type *Arthrobacter* sp. KNK168 polypeptide sequence (GenBank accession: BAK39753.1; G1:336088341): S8P, Y60F, L61Y, H62T, V65A, V69T, D81G, M94I, I96L, F122M, S124T, S126T, G136F, Y150S, V152C, A169L, V199I, A209L, G215C, G217N, S223P, L269P, L273Y. T282S. A284G, P297S, I306V, and S321P. Cloning of SEQ ID NO:1 in the pCK110900 vector system (See e.g, US Patent Application Publication 2006/0195947A1) and subsequent expression in *E. coli* W3110fhuA was as described in U.S. Pat. No. 8,293,507 B2, issued Oct. 23, 2012. Briefly, the *E. coli* W3110 expresses the transaminase polypeptides as an intracellular protein under the control of the lac promoter. The polypeptide accumulates primarily as a soluble cytosolic, active enzyme. Standard methods of directed evolution via iterative variant library generation by gene synthesis followed by screening and sequencing of hits to generate the engineered derivatives of the gene sequence SEQ ID NO:1 disclosed herein. HTP assays used for primary screening were carried out using the cleared cell-lysate from expression of these *E. coli* W3110 cells (see Table 2A and below).

B. HTP Assays

*E. coli* cells expressing the engineered polypeptides were lysed by adding 200 µL of lysis buffer containing 0.1 M TEA buffer. 1 g/L lysozyme, and 0.5 g/L polymyxin B sulfate, and 0.25 mM PLP, at pH 8.5, then shaking (at 250 rpm) for 2 h at room temperature. The general HTP activity assay conditions were: 50 g/L of substrate compound (2). 1 or 1.2 mM PLP, 50% (v/v) DMSO, 20 µL or 40 µL clear cell lysate (containing expressed engineered polypeptide), 1.5 M or 2 M IPM, pH 11 or pH 11.5, and shaking at 200 rpm and 55° C. for 4 h or 18 h. Assay reaction were quenched by addition of 1 mL acetonitrile and shaking for 5 minutes, followed by centrifuge of plate for 10 min at 4000×g at 18° C. Specific lysis and assay reaction conditions are noted in Table 2A.

C. SFP Preparations and Assays

In addition to the HTP assay for primary screening, in some cases a secondary screening was carried out on a 5 mL scale using shake-flask powder (SFP) preparations of the engineered transaminase polypeptides. Shake flask powder (SFP) include approximately 30% total protein and accordingly provide a more purified preparation of an engineered enzyme as compared to the cell lysate used in HTP assays.

For preparing SFPs, a single microbial colony of *E. coli* containing a plasmid encoding an engineered transaminase of interest was inoculated into 50 mL Luria Bertani broth containing 30 µg/mL chloramphenicol (CAM) and 1% glucose. Cells were grown overnight (at least 16 hours) in an incubator at 30° C. with shaking at 250 rpm. The culture was diluted into 250 mL of 2×YT media (Difco) containing 30 µg/ml CAM and 100 mM pyridoxine, in a 1000 mL flask to an optical density at 600 nm ($OD_{600}$) of 0.1 and allowed to grow at 30° C. Expression of the engineered transaminase gene was induced by addition of isopropyl-β-D-thiogalactoside ("IPTG") to a final concentration of 1 mM when the $OD_{600}$ of the culture was 0.6 to 0.8. Incubation was then continued overnight (at least 16 hours). Cells were harvested by centrifugation (5000 rpm, 30 min, 5° C.) and the supernatant discarded. The cell pellet was resuspended with 12 mL of cold (4° C.) 50 mM potassium phosphate buffer pH 8.5, containing 100 µM pyridoxal 5' phosphate, and passed once through a one shot disrupter (Constant System Ltd) at 16 kpsi, while being maintained at 4° C. Cell debris was removed by centrifugation (10000 rpm, 40 minutes, 5° C.). The clear lysate supernatant was collected and stored at −80° C. Lyophilization of frozen clear lysate provides a dry shake-flask powder of crude transaminase polypeptide. Alternatively, the cell pellet (before or after washing) can be stored at 4° C. or −80° C.

The general SFP assay contained following starting reaction mixture in a total volume of 5 mL: 50 g/L substrate of compound (2), 0.5, 1 or 2 g/L of the engineered polypeptide SFP, 1 or 1.2 mM PLP, 1 M or 2 M IPM, 50% (v/v) DMSO, and 0.05 M TEA buffer. The SFP reaction conditions were: pH 10 and 50° C.; pH 11.5 and 55° C.; or pH 11.5 and 60° C. The SFP assay reaction time was 2 or 24 h with stirring at 250 rpm with a magnetic stirrer.

The general protocol for the SFP assay was as follows. A stock solution (premix) was prepared daily for every set of experiments as follows: to 0.5 mL of 10 or 12 mM PLP in sterile water, 0.82 mL of IPM, 2.5 mL DMSO, and substrate compound (2) at 50 g/L concentration. The pH of the premix solution was adjusted with 37% HCl. A 25, 50 or 100 g/L engineered polypeptide stock solution was prepared by dissolving 12.5, 25 or 50 mg of SFP of the polypeptide in 0.5 mL TEA buffer (0.1 M, pH 8.5).

For each experiment, 4.9 mL of premix stock solution was added into a glass screw cap vial. The vial was tightly closed and heated to 50, 55 or 60° C. with magnetic stirring at 250 rpm. A 100 µL of a solution of the enzyme power in 0.2 M borate, pH 10.5 was added to the reaction mixture. The vial was tightly closed and the reaction allowed to continue stirring for 2 or 24 h. The reaction was quenched after 2 or 24 h by addition of 20 mL of acetonitrile.

D. DSP Preparations and Assays

DSP powders of the engineered transaminase polypeptides were prepared as a short batch fermentation followed by a fed batch process according to standard bioprocessing methods with 5 mM pyridoxine HCl added to feed and fermentor media. Briefly, transaminase polypeptide expression was induced by addition of IPTG to a final concentration of 1 mM. Following fermentation, the cells were harvested and resuspended in 100 mM TEA buffer with pH 7.5, then mechanically disrupted by transaminase polypeptide homogenization. The cell debris and nucleic acid was flocculated with polyethylenimine (PEI) and the suspension clarified by centrifugation. The resulting clear supernatant was concentrated using a tangential cross-flow ultrafiltration membrane to remove salts and water. The concentrated and partially purified enzyme concentrate was then dried in a lyophilizer to provide the DSP powder, which was packaged in containers (e.g., polyethylene).

DSP activity assays were carried out at 5 mL scale using the same methods described above for the SFP activity assays with the only difference being that the final assay concentration of the engineered polypeptide DSP was only 0.5 g/L or 1.0 g/L.

E. HPLC Analysis of Assays

After running the HTP. SFP or DSP assays as described above, samples from the acetonitrile quenched assay reaction solutions were analyzed to determine the percent conversion of the substrate of compound (2) to the product of compound (1) as well as the stereoisomeric purity (i.e., % e.e.) of the product using standard achiral and chiral HPLC analytical methods as described in e.g., Example 4 of U.S. Pat. No. 8,293,507 B2 (see also: Savile, et al., 2010, "Biocatalytic asymmetric synthesis of chiral amines from ketones applied to sitagliptin manufacture," *Science* 329 (5989): 305-9 and Supporting Online Materials).

Briefly, percent conversion of the substrate of compound (2) to compound (1) was determined using an Agilent 1200 HPLC equipped with an Agilent Eclipse XDB-C8 column (4.6×150 mm, 5 µm), using 45:55 10 mM $NH_4Ac$/MeCN as eluent at a flow rate of 1.5 ml/min and a column temperature 40° C. Retention times: substrate compound (2)=1.7 min; compound (1)=1.4 min. The substrate and product in the eluent were determined as the peak area at 210 nm or 286 nm, with a path length of 1 cm.

Stereoisomeric purity of compound (1) was determined using an Agilent 1200 HPLC equipped with a Daicel Chiralpak AD-H column (4.6×150 mm, 5 μm) using 60:40:0.1:0.1 EtOH/Heptane/diethylamine/water as the eluent at a flow rate of 0.8 ml/min and a column temperature of 35° C. Retention times: substrate compound (2)=6.3 min; (S)-enantiomeric product compound=8.4 min; compound (1)=10.8 min. The substrate and product were determined as the peak area at 210 nm or 268 nm with a path length of 1 cm.

F. Results

Results of specific activity, stability, and stereopurity assays for the HTP, SFP, and DSP preparations of specific engineered polypeptides having transaminase activity of present disclosure are provided in Tables 2A, 2B, and 2C.

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (306 sequences)

SEQ ID NO: 1 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 2 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 3 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtagggctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 4 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 5 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtcgggctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgatgaccccggtacagtac

SEQ ID NO: 6 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLMTPVQY

SEQ ID NO: 7 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggcttgtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 8 - protein, 330 aa, Artificial Sequence
  Engineered transaminase variant
MAFSADTPEIVYTHDTGLDYITYSDYELDPANPLACGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 9 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccggattctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 10 - protein, 330 aa, Artificial Sequence
  Engineered transaminase variant
MAFSADTPEIVYTHDTGLDYITYSDYELDPANPLAGGAAWIEGAFVPDSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 11 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgacttctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 12 - protein, 330 aa, Artificial Sequence
  Engineered transaminase variant
MAFSADTPEIVYTHDTGLDYITYSDYELDPANPLAGGAAWIEGAFVPTSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 13 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggcgggaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 14 - protein, 330 aa, Artificial Sequence
  Engineered transaminase variant
MAFSADTPEIVYTHDTGLDYITYSDYELDPANPLAGGAAWREGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 15 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaggaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctaatgaccccggtacagtac

SEQ ID NO: 16 - protein, 330 aa, Artificial Sequence
  Engineered transaminase variant
MAFSADTPEIVYTHDTGLDYITYSDYELDPANPLAGGAAWKEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLMTPVQY

SEQ ID NO: 17 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcggtggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 18 - protein, 330 aa, Artificial Sequence
  Engineered transaminase variant
MAFSADTPEIVYTHDTGLDYITYSDYELDPANPLAGGAAWIGGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 19 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaaaagcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 20 - protein, 330 aa, Artificial Sequence
  Engineered transaminase variant
MAFSADTPEIVYTHDTGLDYITYSDYELDPANPLAGGAAWIEGAFVPPSEKRISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 21 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgggttctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 22 - protein, 330 aa, Artificial Sequence
  Engineered transaminase variant
MAFSADTPEIVYTHDTGLDYITYSDYELDPANPLAGGAAWIEGAFVPGSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 23 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccggagtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 24 - protein, 330 aa, Artificial Sequence
  Engineered transaminase variant
MAFSADTPEIVYTHDTGLDYITYSDYELDPANPLAGGAAWIEGAFVPESEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 25 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtttgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 26 - protein, 330 aa, Artificial Sequence
  Engineered transaminase variant
MAFSADTPEIVYTHDTGLDYITYSDYELDPANPLAGGAAWFEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 27 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggagggaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgatgaccccggtacagtac

SEQ ID NO: 28 - protein, 330 aa, Artificial Sequence
  Engineered transaminase variant
MAFSADTPEIVYTHDTGLDYITYSDYELDPANPLAGGAAWREGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLMTPVQY

SEQ ID NO: 29 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgaagtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 30 - protein, 330 aa, Artificial Sequence
  Engineered transaminase variant
MAFSADTPEIVYTHDTGLDYITYSDYELDPANPLAGGAAWIEGAFVPKSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 31 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatccctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 32 - protein, 330 aa, Artificial Sequence
  Engineered transaminase variant
MAFSADTPEIVYTHDTGLDYITYSDYELDPANPLAGGAAWIEGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 33 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatggaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 34 - protein, 330 aa, Artificial Sequence
  Engineered transaminase variant
MAFSADTPEIVYTHDTGLDYITYSDYELDPANPLAGGAAWMEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 35 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaatgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 36 - protein, 330 aa, Artificial Sequence
  Engineered transaminase variant
MAFSADTPEIVYTHDTGLDYITYSDYELDPANPLAGGAAWNEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 37 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgtgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 38 - protein, 330 aa, Artificial Sequence
  Engineered transaminase variant
MAFSADTPEIVYTHDTGLDYITYSDYELDPANPLAGGAAWCEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 39 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgcaggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 40 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAQVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 41 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtttgttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 42 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAFVTVTITRGYSSTPFERDITKHRPQVYMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 43 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtacatttggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 44 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYIWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 45 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggttcagatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 46 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVQMSACPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 47 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtacgtgtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 48 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYVWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 49 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtacaagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 50 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYKWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 51 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtacacttggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 52 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 53 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtacgcttggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 54 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYAWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 55 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctactccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 56 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSATPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 57 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggaccttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 58 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELHDADEVLGCSTGGGVWPFVSVDGNSISDGVPGPVTQSIIRRYWELNVEPSSLLTPVQY

SEQ ID NO: 59 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 60 - protein, 330 aa, Artificial Sequence
  Engineered transaminase variant
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAMVTVTITRGYSSTPFERDITKHRPQVYMSACPYQWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 61 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 62 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 63 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttatatgagcgctagcccgtacacatggatcgtaccgtttgaccgcatcccggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtat

SEQ ID NO: 64 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTWIVPFDRIPDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 65 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 66 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 67 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggcggtcagttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 68 - protein, 330 aa, Artificial Sequence
  Engineered transaminase variant
MAFSADTPEIVYTHDTGLDYITYSDYELDPANPLAGGAAWIGGQFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 69 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgtgaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 70 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 71 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgtgaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 72 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 73 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggcggtcagttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgtgaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 74 - protein, 330 aa, Artificial Sequence
  Engineered transaminase variant
MAFSADTPEIVYTHDTGLDYITYSDYELDPANPLAGGAAWIGGQFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 75 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggcggtcagttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 76 - protein, 330 aa, Artificial Sequence
  Engineered transaminase variant
MAFSADTPEIVYTHDTGLDYITYSDYELDPANPLAGGAAWIGGQFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 77 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 78 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 79 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattgccggtcagttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgtgaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 80 - protein, 330 aa, Artificial Sequence
  Engineered transaminase variant
MAFSADTPEIVYTHDTGLDYITYSDYELDPANPLAGGAAWIAGQFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 81 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggcggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatggcagctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgtgaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 82 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMAASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 83 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggcggtcagttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatggcagctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaggacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 84 - protein, 330 aa, Artificial Sequence
  Engineered transaminase variant
MAFSADTPEIVYTHDTGLDYITYSDYELDPANPLAGGAAWIGGQFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMAASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 85 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtagtgctttccgtctgggggaccacatcgaacgcctgttctctaatgcggaatctattcgtttgatcccgccgctgacccaggacgaagttaaagagatcgctctggaactggttgctaaaaccgaactgcgtgaagcgatggttaccgttgcaatcacccgtggttactcttctaccccattcgagcgtgacatcaccaaacatcgtccgcaggtttacatgagcgctagcccgtacacatggatcgtaccgtttgaccgcatccgggacggtgttcacctgatggttgctcagtcagttcgtcgtacaccgcgtagcactatcgacccgcaggttaaaaacttccagtggggtgacctgatccgtgcaattcaggaaacccacgatcgtggtttcgagttgccgctgctgctggactgcgacaacatgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgaccgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccgatccagtac

SEQ ID NO: 86 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGSAFRLGDHIERLFSNAESIRLIPPLTQDEVKEIALELVAKTELREAMVTVAITRGYSSTPFERDITKHRPQVYMSASPYTWIVPFDRIRDGVHLMVAQSVRRTPRSTIDPQVKNFQWGDLIRAIQETHDRGFELPLLLDCDNMLAEGPGFNVVVIKDGVVRSPGRAALPGITRKTVLEIAESLGHEAILADITPTELYDADEVLGCSTGGGVWPFVSVDGNSISDGVPGPVTQSIIRRYWELNVEPSSLLTPIQY

SEQ ID NO: 87 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagcccgtatcccgttgttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttgcaatcacccgtggttactcttctaccccattcgagcgtgacatcaccaaacatcgtccgcaggtttacatgagcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacatgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgaccgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 88 - protein, 330 aa, Artificial Sequence
  Engineered transaminase variant
MAFSADTPEIVYTHDTGLDYITYSDYELDPANPLAGGAAWIGGAFVPPSEARIPLFDQGFYTSDATYTTFHVWNGNAFRLGDHIERLFSNAESIRLIPPLTQDEVKEIALELVAKTELREAMVTVAITRGYSSTPFERDITKHRPQVYMSASPYTWIVPFDRIRDGVHLMVAQSVRRTPRSSIDPQVKNFQWGDLIRAIQETHDRGFELPLLLDCDNMLAEGPGFNVVVIKDGVVRSPGRAALPGITRKTVLEIAESLGHEAILADITPTELYDADEVLGCSTGGGVWPFVSVDGNSISDGVPGPVTQSIIRRYWELNVEPSSLLTPVQY

SEQ ID NO: 89 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacacatggatcgtaccgtttgaccgcatccgggacggtgttcacctgatggttgctcagtcagttcgtcgtacaccgcgtagcactatcgacccgcaggttaaaaacttccagtggggtgacctgatccgtgcaattcaggaaacccacgatcgtggtttcgagttgccgctgctgctggactgcgacaacatgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgaccgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 90 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTWIVPFDRIRDGVHLMVAQSVRRTPRSTIDPQVKNFQWGDLIRAIQETHDRGFELPLLLDCDNMLAEGPGFNVVVIKDGVVRSPGRAALPGITRKTVLEIAESLGHEAILADITPTELYDADEVLGCSTGGGVWPFVSVDGNSISDGVPGPVTQSIIRRYWELNVEPSSLLTPVQY

SEQ ID NO: 91 - DNA, 990 bp, Artificial Sequence
  Engineered transaminase variant
atggcgttctcaaaagacacccctgaaatcgtttacacccacgacaccggtctggactatatcacctactctgactacgaactggacccggctaacccgctggctggtggtgctgcttggattggaggtgcttttgttccgccgaccgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacacacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 92 - protein, 330 aa, Artificial Sequence
  Engineered transaminase variant
MAFSKDTPEIVYTHDTGLDYITYSDYELDPANPLAGGAAWIGGAFVPPTEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTQIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 93 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgagcgctagcccgtacacacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 94 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMSASPYTQIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 95 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacacacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 96 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTQIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 97 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgagcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 98 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMSASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 99 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgaccgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacacacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 100 - protein, 330 aa, Artificial Sequence
  Engineered transaminase variant
MAFSADTPEIVYTHDTGLDYITYSDYELDPANPLAGGAAWIGGAFVPPTEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTQIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 101 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacacaagtatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 102 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTSIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 103 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctactgaccccggtacagtac

SEQ ID NO: 104 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 105 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 106 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTWIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 107 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacatttcgatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 108 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYISIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 109 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacgtttctatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 110 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYVSIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 111 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacctttcgatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 112 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYLSIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 113 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgagcgctagcccgtacaagtcgatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 114 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYKSIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 115 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcgaccccattcgagcgtgacatcaccaaacatcgtccgcaggtttacatgagcgctagcccgtacacatggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgtcatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 116 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMSASPYTWIVPPDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 117 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacctggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 118 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 119 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 120 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 121 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 122 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 123 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 124 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 125 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 126 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 127 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgacggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacctgtggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 128 - protein, 330 aa, Artificial Sequence
  Engineered transaminase variant
MAFSADTPEIVYTHDTGLDYITYSDYELDPANPLAGGAAWIGGAFVPPTEARIPIFDQGFYTSDATYTTFHVWNGNAFRLGDHIERLFSNAESIRLIPPLTQDEVKEVALELVAKTGLREAMVTVTITRGYSSTPFERDITKHRPQVYMFASPYLWIVPPDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 129 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 130 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 131 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgacggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 132 - protein, 330 aa, Artificial Sequence
  Engineered transaminase variant
MAFSADTPEIVYTHDTGLDYITYSDYELDPANPLAGGAAWCGGAFVPPTEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 133 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacccagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 134 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTQIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 135 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 136 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 137 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaatggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 138 - protein, 330 aa, Artificial Sequence
  Engineered transaminase variant
MAFSADTPEIVYTHDTGLDYITYSDYELDPANPLAGGAAWNGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPPDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 139 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaatggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 140 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKWIVPPDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 141 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaatggaggtgctttcgttccgccgacggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgtggatcgtaccgccggaccgcatccggaacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 142 - protein, 330 aa, Artificial Sequence
  Engineered transaminase variant
MAFSADTPEIVYTHDTGLDYITYSDYELDPANPLAGGAAWNGGAFVPPTEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLWIVPPDRIRNGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 143 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 144 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKWIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 145 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccggagtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 146 - protein, 330 aa, Artificial Sequence
  Engineered transaminase variant
MAFSADTPEIVYTHDTGLDYITYSDYELDPANPLAGGAAWKGGAFVPESEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 147 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacccagatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 148 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTQIVPPDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 149 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacaaatggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 150 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMFASPYKWIVPPDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 151 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatccagatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 152 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIQIVPPDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 153 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 154 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 155 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgtcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 156 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 157 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacctggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 158 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPPDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 159 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacatccagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 160 - protein, 330 aa, Artificial Sequence
  Engineered transaminase variant
MAFSADTPEIVYTHDTGLDYITYSDYELDPANLLAGGAAWIGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMFASPYIQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 161 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 162 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 163 - DNA, 990 bp, Artificial Sequence; identical to SEQ ID NO: 65
  Engineered transaminase variant

SEQ ID NO: 164 - protein, 330 aa, Artificial Sequence; identical to SEQ ID NO: 66
  Engineered transaminase variant

SEQ ID NO: 165 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacccagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 166 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYTQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 167 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 168 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPPDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 169 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacctgtggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 170 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMFASPYLWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 171 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 172 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 173 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgacggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 174 - protein, 330 aa, Artificial Sequence
  Engineered transaminase variant
MAFSADTPEIVYTHDTGLDYITYSDYELDPANPLAGGAAWCGGAFVPPTEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPPDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 175 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgtggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 176 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLWIVPPDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 177 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggccggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 178 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 179 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccggagtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgtggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 180 - protein, 330 aa, Artificial Sequence
  Engineered transaminase variant
MAFSADTPEIVYTHDTGLDYITYSDYELDPANPLAGGAAWKGGAFVPESEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 181 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggtggtgctgcttggaaaggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 182 - protein, 330 aa, Artificial Sequence
  Engineered transaminase variant
MAFSADTPEIVYTHDTGLDYITYSDYELDPANLLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPPDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 183 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacctgtggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 184 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMFASPYLWIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 185 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaatggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacacccagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 186 - protein, 330 aa, Artificial Sequence
  Engineered transaminase variant
MAFSADTPEIVYTHDTGLDYITYSDYELDPANPLAGGAAWNGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMFASPYTQIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 187 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacgtgcagatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 188 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYVQIVPPDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 189 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacccagatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 190 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTQIVPPDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 191 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggtggtgctgcttggtgcggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaatggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 192 - protein, 330 aa, Artificial Sequence
  Engineered transaminase variant
MAFSADTPEIVYTHDTGLDYITYSDYELDPANLLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKWIVPPDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 193 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 194 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPPDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 195 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 196 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 197 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgacggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacaaacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 198 - protein, 330 aa, Artificial Sequence
  Engineered transaminase variant
MAFSADTPEIVYTHDTGLDYITYSDYELDPANPLAGGAAWIGGAFVPPTEARIPIFDQGFYTSDATYTTFHVWNGNAFRLGDHIERLFSNAESIRLIPPLTQDEVKEVALELVAKTGLREAMVTVTITRGYSSTPFERDITKHRPQVYMFASPYKQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 199 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacaaatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 200 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMFASPYKWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 201 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatccagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 202 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIQIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 203 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacacggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 204 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTRIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 205 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacaaatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 206 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEVALELVAKTGLREAMVTVTITRGYSSTPFERDITKHRPQVYMFASPYKWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 207 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaacagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 208 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 209 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 210 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPPDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 211 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacaaatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacttagacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 212 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTGLREAMVTVTITRGYSSTPFERDITKHRPQVYMFASPYKWIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 213 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 214 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 215 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggaaaggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 216 - protein, 330 aa, Artificial Sequence
  Engineered transaminase variant
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 217 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggtgcggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaaatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 218 - protein, 330 aa, Artificial Sequence
  Engineered transaminase variant
MAFSADTPEIVYTHDTGLDYITYSDYELDPANPLAGGAAWCGGAFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYKWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 219 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgacggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccggcctgcgtgaagcgatggttaccgttacgatcacccgtggttactcttctaccccattcgagcgtgacatcaccaaacatcgtccgcaggtttacatgttcgctagcccgtacacccagatcgtaccgccggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgttaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 220 - protein, 330 aa, Artificial Sequence
  Engineered transaminase variant
MAFSADTPEIVYTHDTGLDYITYSDYELDPANPLAGGAAWIGGAFVPPTEARIPIFDQGFYTSDATYTTFHVWNGNAFRLGDHIERLFSNAESIRLIPPLTQDEVKEVALELVAKTGLREAMVTVTITRGYSSTPFERDITKHRPQVYMFASPYTQIVPPDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 221 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggtggtgctgcttggattggaggtgctttcgttccgggctctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 222 - protein, 330 aa, Artificial Sequence
  Engineered transaminase variant
MAFSADTPEIVYTHDTGLDYITYSDYELDPANLLAGGAAWIGGAFVPGSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 223 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggcttgcggtgctgcttggattggaggtgctttcgttccgccgtctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaagtggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtcgtgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 224 - protein, 330 aa, Artificial Sequence
  Engineered transaminase variant
MAFSADTPEIVYTHDTGLDYITYSDYELDPANPLACGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKWIVPFDRIRDGVHLMVAQSVRRTPRSSIDPQVKNFQWGDLIRAIQETHDRGFELPLLLDHDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 225 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggcttgcggtgctgcttggattggaggtgctttcgttccgaagtctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 226 - protein, 330 aa, Artificial Sequence
  Engineered transaminase variant
MAFSADTPEIVYTHDTGLDYITYSDYELDPANPLACGAAWIGGAFVPKSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 227 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggcttgcggtgctgcttggattggaggtgctttcgttccgggctctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 228 - protein, 330 aa, Artificial Sequence
  Engineered transaminase variant
MAFSADTPEIVYTHDTGLDYITYSDYELDPANPLACGAAWIGGAFVPGSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 229 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagaggtggctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaagtggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 230 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEVALELVAKTELREAMVTVTITRGYSSTPFERDITKHRPQVYMFASPYKWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 231 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgggctctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 232 - protein, 330 aa, Artificial Sequence
  Engineered transaminase variant
MAFSADTPEIVYTHDTGLDYITYSDYELDPANPLAGGAAWIGGAFVPGSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 233 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgtggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 234 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 235 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggcttgcggtgctgcttggattggaggtgctttcgttccgccgtctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtcgtgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtctggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 236 - protein, 330 aa, Artificial Sequence
  Engineered transaminase variant
MAFSADTPEIVYTHDTGLDYITYSDYELDPANPLACGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPFDRIRDGVHLMVAQSVRRTPRSSIDPQVKNFQWGDLIRAIQETHDRGFELPLLLDHDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 237 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggcttgcggtgctgcttggattggaggtgctttcgttccgaagtctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 238 - protein, 330 aa, Artificial Sequence
  Engineered transaminase variant
MAFSADTPEIVYTHDTGLDYITYSDYELDPANPLACGAAWIGGAFVPKSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 239 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacatctggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 240 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 241 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggcttgcggtgctgcttggattggaggtgctttcgttccgccgtctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacacatggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactgcgacaacctgctggctgaaggtccgggtttcaacgttgttgttatcaaagacggtgttgttcgttctccgggtcgtcgtgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 242 - protein, 330 aa, Artificial Sequence
  Engineered transaminase variant
MAFSADTPEIVYTHDTGLDYITYSDYELDPANPLACGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYTWIVPFDRIRDGVHLMVAQSVRRTPRSSIDPQVKNFQWGDLIRAIQETHDRGFELPLLLDCDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 243 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggcttgcggtgctgcttggattggaggtgctttcgttccgccatctgaagcgcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacgtctggatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 244 - protein, 330 aa, Artificial Sequence
  Engineered transaminase variant
MAFSADTPEIVYTHDTGLDYITYSDYELDPANPLACGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYVWIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 245 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggcggtgctgcttggattggaggtgctttcgttccgccatcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaagcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccacgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 246 - protein, 330 aa, Artificial Sequence
  Engineered transaminase variant
MAFSADTPEIVYTHDTGLDYITYSDYELDPANLLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 247 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggcggtgctgcttggattggaggtgctttcgttccgggttcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagattgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccacgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 248 - protein, 330 aa, Artificial Sequence
  Engineered transaminase variant
MAFSADTPEIVYTHDTGLDYITYSDYELDPANPLAGGAAWIGGAFVPGSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 249 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggcggtgctgcttggattggaggtgctttcgttccgccatcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtaccttcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccacgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 250 - protein, 330 aa, Artificial Sequence
  Engineered transaminase variant
MAFSADTPEIVYTHDTGLDYITYSDYELDPANLLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 251 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggcggtgctgcttggattggaggtgctttcgttccgccatcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatttctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacaagcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccacgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 252 - protein, 330 aa, Artificial Sequence
  Engineered transaminase variant
MAFSADTPEIVYTHDTGLDYITYSDYELDPANLLAGGAAWIGGAFVPPSEARIPIFDQGFYTSDATYTTFHVWNGNAFRLGDHIERLFSNAESIRLIPPLTQDEVKEISLELVAKTELREAMVTVTITRGYSSTPFERDITKHRPQVYMFASPYKQIVPFDRIRDGVHLMVAQSVRRTPRSSIDPQVKNFQWGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 253 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggcggtgctgcttggattggaggtgctttcgttccgccatcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagattgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtaccttcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccacgacaacctgctggctgaaggtccgggtttcaacgttgttgttatcaaagacggtgttgttcgttctccgggtcgtagggctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 254 - protein, 330 aa, Artificial Sequence
  Engineered transaminase variant
MAFSADTPEIVYTHDTGLDYITYSDYELDPANLLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDHDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 255 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggttcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 256 - protein, 330 aa, Artificial Sequence
  Engineered transaminase variant
MAFSADTPEIVYTHDTGLDYITYSDYELDPANPLAGGAAWFGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 257 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggttcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgcaggttaccgttacgatcacccgtggttactcttctaccccattcgagcgtgacatcaccaaacatcgtccgcaggtttatatgttcgctaccccgtacgttcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgcggctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 258 - protein, 330 aa, Artificial Sequence
  Engineered transaminase variant
MAFSADTPEIVYTHDTGLDYITYSDYELDPANPLAGGAAWFGGAFVPPSEARIPIFDQGFYTSDATYTTFHVWNGNAFRLGDHIERLFSNAESIRLIPPLTQDEVKEIALELVAKTELREAQVTVTITRGYSSTPFERDITKHRPQVYMFATPYVQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 259 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggataggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgcaggttaccgttacgatcacccgtggttactcttctaccccattcgagcgtgacatcaccaaacatcgtccgcaggtttatatgttcgctaccccgtacgttcagatcgtaccgtttgaccgcatccgggacggtgttcacctgatgattgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtcgagctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 260 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAQVTVTITRGYSSTPFERDITKHRPQVYMFATPYVQIVPFDRIRDGVHLMIAQSVRRTPRSSIDPQVKNFQWGDLIRAIQETHDRGFELPLLLDGDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 261 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggttcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacattcagatcgtaccgtttgaccgcatccgggacggtgttcacctgatgattgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgcggctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 262 - protein, 330 aa, Artificial Sequence
  Engineered transaminase variant
MAFSADTPEIVYTHDTGLDYITYSDYELDPANPLAGGAAWFGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIQIVPFDRIRDGVHLMIAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 263 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggttcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatgattgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtcgagctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 264 - protein, 330 aa, Artificial Sequence
  Engineered transaminase variant
MAFSADTPEIVYTHDTGLDYITYSDYELDPANPLAGGAAWFGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMIAQSVRRTPRSSIDPQVKNFQWGDLIRAIQETHDRGFELPLLLDGDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 265 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggataggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttatatgttcgctagcccgtacattcagatcgtaccgtttgaccgcatccgggacggtgttcacctgatgattgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtcgagctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 266 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIQIVPFDRIRDGVHLMIAQSVRRTPRSSIDPQVKNFQWGDLIRAIQETHDRGFELPLLLDGDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 267 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggttcggaggtgctttcgttccgccatcggaagcacgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacattcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgcggctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 268 - protein, 330 aa, Artificial Sequence
  Engineered transaminase variant
MAFSADTPEIVYTHDTGLDYITYSDYELDPANPLAGGAAWFGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 269 - DNA, 990 bp, Artificial Sequence
  Engineered transaminase variant
atggcgttctcagcggacacccctgaaatcgtttacacccacgacaccggtctggactatatcacctactctgactacgaactggacccggctaacctgctggctggcggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacattcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 270 - protein, 330 aa, Artificial Sequence
  Engineered transaminase variant
MAFSADTPEIVYTHDTGLDYITYSDYELDPANLLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYIQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 271 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggttcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatgattgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 272 - protein, 330 aa, Artificial Sequence
  Engineered transaminase variant
MAFSADTPEIVYTHDTGLDYITYSDYELDPANPLAGGAAWFGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMIAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 273 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggataggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgcaggttaccgttacgatcacccgtggttactcttctaccccattcgagcgtgacatcaccaaacatcgtccgcaggtttatatgttcgctagcccgtacattcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtcgagctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 274 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAQVTVTITRGYSSTPFERDITKHRPQVYMFASPYIQIVPFDRIRDGVHLMVAQSVRRTPRSSIDPQVKNFQWGDLIRAIQETHDRGFELPLLLDGDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 275 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggataggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgcaggttaccgttacgatcacccgtggttactcttctaccccattcgagcgtgacatcaccaaacatcgtccgcaggtttatatgttcgctagcccgtacctgcagatcgtaccgtttgaccgcatccgggacggtgttcacctgatgattgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtcgagctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 276 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAQVTVTITRGYSSTPFERDITKHRPQVYMFASPYLQIVPFDRIRDGVHLMIAQSVRRTPRSSIDPQVKNFQWGDLIRAIQETHDRGFELPLLLDGDNLLAEGPGFNVVVIKDGVVRSPGRRALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 277 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacctctgacgctacctacaccagcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccatttgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 278 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTSFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 279 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcgagcggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 280 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSSGGGVWPFVSVDGNSISDGVPGPVTQSIIRRYWELNVEPSSLLTPVQY

SEQ ID NO: 281 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccgtttgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgcgttaccattggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 282 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCVTIGGVWPFVSVDGNSISDGVPGPVTQSIIRRYWELNVEPSSLLTPVQY

SEQ ID NO: 283 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccgtatgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgcgttacccctggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 284 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPYERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCVTPGGVWPFVSVDGNSISDGVPGPVTQSIIRRYWELNVEPSSLLTPVQY

SEQ ID NO: 285 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccgtttgagcgtgacatcaccaaacatcgtccgcaggtttacatgttcgctagcccgtacctgtatatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgcagcaccggcggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 286 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLYIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 287 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccgatagagcgtgacatcaccaaacatcgtccgcaggtttacatgttcgctagcccgtacctgtatatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgcgttaccattggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 288 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPIERDITKHRPQVYMFASPYLYIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCVTIGGVWPFVSVDGNSISDGVPGPVTQSIIRRYWELNVEPSSLLTPVQY

SEQ ID NO: 289 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccatttgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccattggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 290 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTIGGVWPFVSVDGNSISDGVPGPVTQSIIRRYWELNVEPSSLLTPVQY

SEQ ID NO: 291 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccgatagagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 292 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPIERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 293 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccgatagagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgatcttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 294 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPIERDITKHRPQVYMFASPYLQIVPFDRIRDGVHLMVAQSVRRTPRSSIDPQVKNFQWGDLIRAIQETHDRGFELPLLLDGDNLLAEGPIFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 295 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccgatagagcgtgacatcaccaaacatcgtccgcaggtttacatgttcgctagcccgtacctgtatatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgcagcacccctggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 296 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPIERDITKHRPQVYMFASPYLYIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTPGGVWPFVSVDGNSISDGVPGPVTQSIIRRYWELNVEPSSLLTPVQY

SEQ ID NO: 297 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccatttatgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagttcggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 298 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTIYERDITKHRPQVYMFASPYLQIVPFDRIRDGVHLMVAQSVRRTPRSSIDPQVKNFQFGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 299 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttatgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 300 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVMITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 301 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggatggacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 302 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWMDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 303 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacgcaaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 304 - protein, 330 aa, Artificial Sequence
  Engineered transaminase variant
MAFSADTPEIVYTHDTGLDYITYSDYELDPANPLAGGAAWIGGAFVPPSEARIPIFDQGFYTSDATYATFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 305 - DNA, 990 bp, Artificial Sequence
  Engineered transaminase variant
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtgtttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 306 - protein, 330 aa, Artificial Sequence
  Engineered transaminase variant
MAFSADTPEIVYTHDTGLDYITYSDYELDPANPLAGGAAWIGGAFVPPSEARIPIFDQGVYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

What is claimed is:

1. An engineered polypeptide having transaminase activity comprising an amino acid sequence having at least 90% sequence identity to reference sequence of SEQ ID NO:2 and an amino acid residue difference as compared to SEQ ID NO:2 at position 126, wherein said amino acid residue at position 126 is alanine, and further wherein said engineered polypeptide is capable of converting a substrate compound (2)

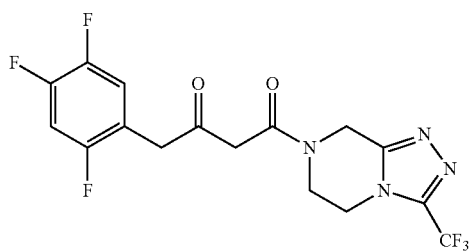

(2)

to a product compound (1)

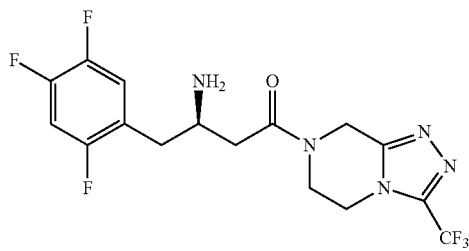

(1)

under suitable reaction conditions.

2. The engineered polypeptide of claim 1, in which the amino acid sequence further comprises one or more residue differences as compared to SEQ ID NO:2, selected from: X5K, X33L, X36C, X41C/F/K/M/N/R, X42A/G, X44Q, X48D/E/G/K/T, X49T, X51K, X54P, X55L, X76S, X108V, X117G, X122F/Q, X148Q, X150A/F, X152S/T, X155A/I/K/L/T/V, X156Q/R/S, X160P, X164P, X165N, X182T, X215G/H/L, X218M, X241R, X267V, X270T, X273H, X325M, and X328I.

3. The engineered polypeptide having transaminase activity comprising an amino acid sequence having at least 90% sequence identity to reference sequence of SEQ ID NO:2 of claim 1, and further comprising:
   (a) an amino acid residue difference as compared to SEQ ID NO:2 selected from G36C, I41C, I41F, I41K, I41M, I41N, I41R, E42G, P48D, P48E, P48G, P48K, P48T, A51K, S54P, M122F, M122Q, Y148Q, C152T, Q155A, Q155I, Q155K, Q155T, Q155V, C215H, C215L, Y273H, L325M, and A241R; or
   (b) a combination of residue differences selected from: A5K, E42G, S49T, S54P, C152S, Q155T, and W156Q; P33L, I41C, E42G, S54P, S150F, C152S, Q155K, F160P, and C215G; P33L, I41K, E42G, S54P, S150F, C152S, Q155I, F160P, and C215L; P33L, E42G, P48G, S54P, S150F, C152S, Q155T, and C215H; P33L, E42G, S54P, A109S, S150F, C152S, Q155K, W156Q, and C215H; P33L, E42G, S54P, E117G, S150F, C152S, Q155I, W156Q, and C215G; P33L, E42G, S54P, S150F, C152S, Q155I, W156Q, and C215G; P33L, E42G, S54P, S150F, C152S, Q155K, W156Q, and C215H; P33L, E42G, S54P, S150F, C152S, Q155L, W156Q, and C215H; P33L, E42G, S54P, S150F, C152S, Q155L, W156Q, C215H, and A241R; G36C, E42G, P48G, S54P, S150F, C152S, Q155I, and C215H; G36C, E42G, P48K, S54P, S150F, C152S, Q155T, and C215H; G36C, E42G, S54P, S150F, C152S, Q155I, C215H, and A241R; G36C, E42G, S54P, S150F, C152S, Q155K, C215H, and A241R;

G36C, E42G, S54P, S150F, C152S, Q155T, and A241R; G36C, E42G, S54P, S150F, C152S, Q155V, and C215H; I41C, E42G, S49T, S54P, S150F, C152S, Q155I, F160P, C215G, and I267V; I41C, E42G, S49T, S54P, S150F, C152S, Q155K, W156Q, C215G and I267V; I41C, E42G, S54P, I108V, S150F, C152S, and Q155K; I41C, E42G, S54P, I108V, S150F, C152S, Q155K, W156Q, C215G, and I267V; I41C, E42G, S54P, I108V, S150F, C152S, Q155T, W156Q, and C215G; I41C, E42G, S54P, E117G, S150F, C152S, Q155K, and F160P; I41C, E42G, S54P, E117G, S150F, C152S, Q155K, and C215L; I41C, E42G, S54P, E117G, S150F, C152S, Q155L, and C215L; I41C, E42G, S54P, S150F, C152S, Q155I, and C215G; I41C, E42G, S54P, S150F, C152S, Q155I, and C215L; I41C, E42G, S54P, S150F, C152S, Q155K, W156Q, C215G, and I267V; I41C, E42G, S54P, S150F, C152S, Q155K, and C215L; I41C, E42G, S54P, S150F, C152S, Q155K, and C215G; I41C, E42G, S54P, S150F, C152S, Q155L, F160P, C215G, and I267V; I41C, E42G, S54P, S150F, C152S, Q155T, W156Q, F160P, and C215L; I41C, E42G, S54P, S150F, C152S, Q155T, W156Q, and C215L; I41F, E42G, S54P, M122Q, S150F, C152T, Q155V, W156Q, and C215G; I41F, E42G, S54P, S150F, C152S, Q155L, W156Q, V171I, and C215G; I41F, E42G, S54P, S150F, C152S, Q155L, W156Q, V171I, C215G, and A241R; I41F, E42G, S54P, S150F, C152S, Q155I, W156Q, and C215G; I41K, E42G, P48E, S54P, S150F, C152S, Q155K, and W156Q; I41K, E42G, P48E, S54P, S150F, C152S, Q155L, and C215L; I41K, E42G, S54P, I108V, E117G, S150F, C152S, Q155K, and C215L; I41K, E42G, S54P, I108V, S150F, C152S, Q155T, and C215G; I41K, E42G, S54P, E117G, S150F, C152S, Q155L, and C215G; I41K, E42G, S54P, E117G, S150F, C152S, Q155K, C215L, and I267V; I41K, E42G, S54P, S150F, C152S, Q155K, W156Q, and C215G; I41K, E42G, S54P, S150F, C152S, Q155K, F160P, C215G, and I267V; I41K, E42G, S54P, S150F, C152S, Q155K, and C215L; I41K, E42G, S54P, S150F, C152S, and Q155T; I41K, E42G, S54P, S150F, C152S, Q155T, and F160P; I41K, E42G, S54P, S150F, C152S, Q155T, C215G, and I267V; I41K, E42G, S54P, S150F, C152S, Q155W, W156Q, and C215G; I41N, E42G, S54P, S150F, C152S, Q155I, and F160P; I41N, E42G, S54P, E117G, S150F, C152S, Q155T, and W156Q; I41N, S49T, E42G, S54P, S150F, C152S, Q155L, F160P, D165N, and C215L; E42A, A44Q, S54P, I108V, S150F, C152S, Q155T, and I267V; E42G, A44Q, S54P, I108V, S150F, C152S, and Q155T; E42G, A44Q, S54P, I108V, S150F, C152S, Q155T, and I267V; E42G, A44Q, S54P, S150A, C152S, and Q155T; E42G, A44Q, S54P, S150F, C152S, and Q155T; E42G, P48G, S54P, S150F, C152S, Q155L, W156Q, and C215H; E42G, P48G, S54P, S150F, C152S, and Q155T; E42G, S49T, S54P, I108V, E117G, S150F, C152S, Q155L, F160P, and C215L; E42G, S49T, S54P, I108V, E117G, S150F, C152S, Q155K, W156Q, and C215G; E42G, S49T, S54P, I108V, E117G, S150F, C152S, Q155T, W156Q, C215G, and I267V; E42G, S49T, S54P, C152S, Q155T, and W156Q; E42G, S54P, I55L, C152S, Q155T, L218M, and A270T; E42G, S54P, F60V, S150F, C152S, Q155L, W156Q, and C215G; E42G, S54P, T68A, S150F, C152S, Q155L, W156Q, and C215G; E42G, S54P, T69S, S150F, C152S, Q155L, W156Q, and C215G; E42G, S54P, N76S, C152S, Q155T, S182T, L218M, A270T, and V328I; E42G, S54P, I108V, S150F, C152S, Q155K, and C215H; E42G, S54P, I108V, S150F, C152S, and Q155T; E42G, S54P, I108V, S150F, C152S, Q155T, and I267V; E42G, S54P, I108V, S150F, C152S, Q155V, W156Q, and F160P; E42G, S54P, E117G, C152S, and Q155T; E42G, S54P, E117G, C152S, Q155T, and W156Q; E42G, S54P, M122Q, S150F, C152S, Q155I, W156Q, C215G, and A241R; E42G, S54P, M122Q, S150F, C152S, Q155L, W156Q, V171I, C215G, and A241R; E42G, S54P, M122Q, S150F, C152T, Q155V, W156Q, V171I, C215G, and A241R; E42G, S54P, T126M, S150F, C152S, Q155L, W156Q, and C215G; E42G, S54P, P135I, F136Y, S150F, C152S, Q155L, W156Q, W192F, and C215G; E42G, S54P, F136I, S150F, C152S, Q155L, W156Q, and C215G; E42G, S54P, F136I, S150F, C152S, Q155L, W156Q, C215G, and G224I; E42G, S54P, F136I, S150F, C152S, Q155L, W156Y, C215G, S282V, and G284I; E42G, S54P, F136I, S150F, C152S, Q155L, W156Y, C215G, and G284P; E42G, S54P, F136Y, S150F, C152S, Q155L, W156Q, C215G, S282V, and G284P; E42G, S54P, S150A, C152S, Q155T, and I267V; E42G, S54P, S150F, C152S, Q155I, W156Q, F160P, C215L, and I267V; E42G, S54P, S150F, C152S, Q155I, W156Q, V171I, C215G, and A241R; E42G, S54P, S150F, C152S, Q155I, W156Q, and C215L; E42G, S54P, S150F, C152S, Q155I, F160P, and C215G; E42G, S54P, S150F, C152S, Q155I, and C215H; E42G, S54P, S150F, C152S, Q155K, and W156Q; E42G, S54P, S150F, C152S, Q155K, W156Q, and I267V; E42G, S54P, S150F, C152S, Q155L, W156Q, G193M, and C215G; E42G, S54P, S150F, C152S, Q155L, W156Q, and C215G; E42G, S54P, S150F, C152S, Q155L, W156Q, C215G, S282V, and G284I; E42G, S54P, S150F, C152S, Q155L, W156Q, C215G, and T283S; E42G, S54P, S150F, C152S, Q155L, W156Q, C215G, and G284I; E42G, S54P, S150F, C152S, Q155L, W156Y, and C215G; E42G, S54P, S150F, C152S, Q155L, and C215H; E42G, S54P, S150F, C152S, and Q155T; E42G, S54P, S150F, C152S, Q155T, C215G, and I267V; E42G, S54P, S150F, C152S, Q155T, and I267V; E42G, S54P, S150F, C152S, Q155T, W156Q, F160P, C215L, and I267V; E42G, S54P, S150F, C152S, Q155T, W156Q, C215G, and I267V; E42G, S54P, S150F, C152S, Q155T, and W156R; E42G, S54P, S150F, C152S, Q155T, F160P, and C215G; E42G, S54P, S150F, C152S, Q155T, F160P, and C215L; E42G, S54P, S150F, C152S, Q155T, C215G, and I267V; E42G, S54P, S150F, C152S, Q155T, and I267V; E42G, S54P, C152S, Q155I, and W156S; E42G, S54P, C152S, Q155K, and W156S; E42G, S54P, C152S, Q155L, and W156S; E42G, S54P, C152S, and Q155T; E42G, S54P, C152S, Q155T, and F160P; E42G, S54P, C152S, Q155T, and R164P; E42G, S54P, C152S, Q155T, and W156Q; E42G, S54P, C152S, Q155T, and W156S; E42G, S54P, C152S, Q155T, and R164P; E42G, S54P, C152S, Q155T, S182T, L218M, and A270T; E42G, S54P, C152S, Q155T, and C215G; E42G, S54P, C152S, Q155T, and C215L; and E42G, S54P, C152S, Q155V, and W156S.

4. The engineered polypeptide of claim 1, which is capable of converting compound (2) to compound (1) with at least 1.2 fold the activity of SEQ ID NO:2 under suitable reaction conditions.

5. The engineered polypeptide of claim 4, in which the suitable reaction conditions comprise compound (2) loading of at least 50 g/L, 1 mM PLP, 50% DMSO (v/v), 1.5 M isopropylamine, pH 11, and 55° C.

6. The engineered polypeptide of claim 1, in which the amino acid sequence comprises SEQ ID NO:86.

7. The engineered polypeptide of claim 1, in which the polypeptide is immobilized on a solid support.

8. The engineered polypeptide of claim 7, in which the solid support is a bead or resin comprising polymethacrylate with epoxide functional groups, polymethacrylate with amino epoxide functional groups, styrene/DVB copolymer or polymethacrylate with octadecyl functional groups.

9. A process of preparing compound (1)

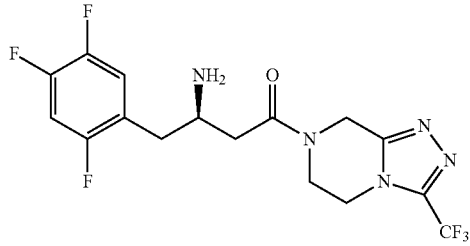

(1)

comprising a step of contacting a substrate of compound (2)

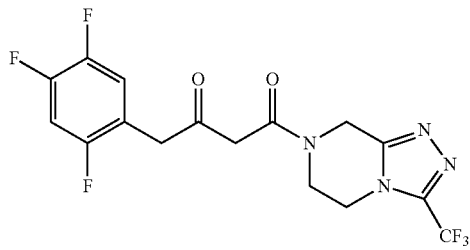

(2)

with an engineered polypeptide of claim 1, in the presence of an amino group donor under suitable reaction conditions.

10. The process of claim 9, wherein the compound of Formula (I), the compound of Formula (Ia), or the compound (1) is produced in at least 90% enantiomeric excess.

11. The process of claim 9, wherein the compound of Formula (I), the compound of Formula (Ia), or the compound (1) is produced in at least 99% enantiomeric excess.

12. The process of claim 9, wherein the amino group donor is selected from isopropylamine, alanine, 3-aminobutyric acid, or methylbenzylamine.

13. The process of claim 12, wherein the amino group donor is isopropylamine, optionally at a concentration of about 0.1 to about 3.0 M, 0.2 to about 2.5 M, about 0.5 to about 2 M or about 1 to about 2 M.

14. The process of claim 9, wherein the suitable reaction conditions comprise a pH of from about pH 9.5 to about pH 11.5.

15. The process of claim 9, wherein the suitable reaction conditions comprise a temperature of about 45° C. to about 60° C.

16. The process of claim 9, wherein the suitable reaction conditions comprise dimethylsulfoxide (DMSO) at about 30% (v/v) to about 60% (v/v).

17. The process of claim 9, wherein the suitable reaction conditions comprise the substrate compound at a loading of about 5 g/L to about 200 g/L, about 10 g/L to about 150 g/L, or about 50 g/L to about 100 g/L.

18. The process of claim 9, wherein the suitable reaction conditions comprise the engineered polypeptide at a concentration of from about 0.5 g/L to about 5 g/L, about 0.5 g/L to about 3 g/L, about 0.5 g/L to about 2 g/L, or from about 0.5 g/L to about 1 g/L.

19. The process of claim 9, wherein the suitable reaction conditions comprise: (a) substrate loading of about 10 to 200 g/L of substrate compound (2); (b) engineered polypeptide concentration of about 0.5 g/L to 5 g/L; (c) IPM concentration of about 0.1 to 3 M; (d) PLP cofactor concentration of about 0.1 to 1 mM; (e) DMSO concentration of about 30% (v/v) to about 60% (v/v); (f) pH of about 9.5 to 11.5; and (g) temperature of about 45° C. to 60° C.

20. The process of claim 9, wherein the suitable reaction conditions comprise: (a) about 50 g/L of substrate compound (2); (b) about 2 g/L engineered polypeptide; (c) about 50% (v/v) dimethylsulfoxide (DMSO); (d) about 1 M isopropylamine (IPM); (e) about 1 mM pyridoxal phosphate (PLP); (f) about pH 10; and (g) about 50° C.

21. The process of claim 9, further comprising the step of isolating the compound of Formula (I), the compound of Formula (Ia), or the compound (1) from the reaction.

22. The process of claim 9, further comprising the step of converting the compound of Formula (Ia), or the compound (1) into a pharmaceutically acceptable salt by contacting said compound with a pharmaceutically acceptable acid in a suitable reaction solvent.

23. The process of claim 22, wherein the pharmaceutically acceptable acid is phosphoric acid and the pharmaceutically acceptable salt is the dihydrogen phosphate salt.

24. The process of claim 23, further comprising the step of crystallizing the pharmaceutically acceptable salt from the reaction solvent.

25. A process for the preparation of (2R)-4-oxo-4-[3-(trifluoromethyl)-5,6-dihydro[1,2,4]triazolo[4,3-a]pyrazin-7(8H)-yl]-1-(2,4,5-trifluorophenyl)butan-2-amine phosphate (1:1) monohydrate, the process comprising a step of converting a substrate compound (2)

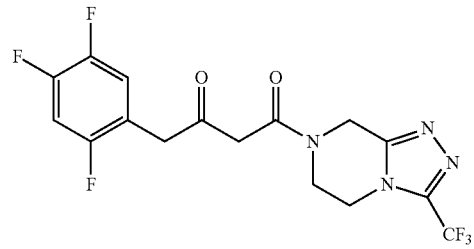

(2)

to a product compound (1)

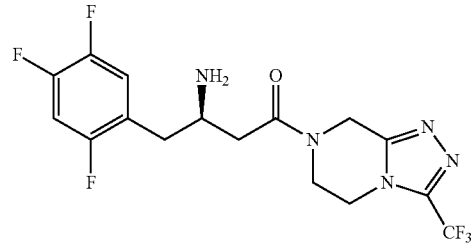

(1)

by contacting a substrate of compound (2) with an engineered polypeptide of claim 1, in the presence of an amino group donor under suitable reaction conditions.

26. The method of claim 25, in which the amino group donor is isopropylamine.

* * * * *

UNITED STATES PATENT AND TRADEMARK OFFICE
CERTIFICATE OF CORRECTION

PATENT NO. : 9,617,573 B2
APPLICATION NO. : 14/768408
DATED : April 11, 2017
INVENTOR(S) : Quintanar-Audelo et al.

It is certified that error appears in the above-identified patent and that said Letters Patent is hereby corrected as shown below:

In the Claims

In Claim 3, Column 76, Line 50, please replace "ASK" with "A5K".

Signed and Sealed this
Twenty-third Day of May, 2017

Michelle K. Lee
*Director of the United States Patent and Trademark Office*